(12) United States Patent
Heiland

(10) Patent No.: US 12,358,962 B2
(45) Date of Patent: *Jul. 15, 2025

(54) LAMP CONSTRUCTS COMPRISING CANCER ANTIGENS

(71) Applicant: Immunomic Therapeutics, Inc, Rockville, MD (US)

(72) Inventor: Teri Heiland, New Market, MD (US)

(73) Assignee: Immunomic Therapeutics, Inc., Rockville, MD (US)

( * ) Notice: Subject to any disclaimer, the term of this patent is extended or adjusted under 35 U.S.C. 154(b) by 814 days.

This patent is subject to a terminal disclaimer.

(21) Appl. No.: 16/610,133

(22) PCT Filed: May 2, 2018

(86) PCT No.: PCT/US2018/030725
§ 371 (c)(1),
(2) Date: Nov. 1, 2019

(87) PCT Pub. No.: WO2018/204534
PCT Pub. Date: Nov. 8, 2018

(65) Prior Publication Data
US 2020/0087365 A1    Mar. 19, 2020

Related U.S. Application Data

(60) Provisional application No. 62/561,760, filed on Sep. 22, 2017, provisional application No. 62/500,053, filed on May 2, 2017.

(51) Int. Cl.
| | | |
|---|---|---|
| *A61K 39/00* | (2006.01) | |
| *A61K 47/62* | (2017.01) | |
| *C07K 14/47* | (2006.01) | |
| *C07K 14/82* | (2006.01) | |
| *C12N 5/10* | (2006.01) | |
| *C12N 15/62* | (2006.01) | |

(52) U.S. Cl.
CPC ...... *C07K 14/4748* (2013.01); *A61K 39/0011* (2013.01); *A61K 47/62* (2017.08); *C07K 14/82* (2013.01); *A61K 2039/6031* (2013.01); *A61K 2039/64* (2013.01)

(58) Field of Classification Search
None
See application file for complete search history.

(56) References Cited

U.S. PATENT DOCUMENTS

| | | | |
|---|---|---|---|
| 8,318,173 | B2 | 11/2012 | August et al. |
| 11,203,629 | B2 * | 12/2021 | Heiland ............. A61P 35/00 |
| 11,773,153 | B2 * | 10/2023 | Heiland ............. A61P 35/00 |
| | | | 424/185.1 |
| 2004/0157307 | A1 | 8/2004 | Harris et al. |
| 2007/0269457 | A1 | 11/2007 | Niazi et al. |
| 2009/0093050 | A1 | 4/2009 | Wu et al. |
| 2012/0294879 | A1 | 11/2012 | August et al. |
| 2016/0185831 | A1 | 6/2016 | Hearl et al. |
| 2016/0271245 | A1 | 9/2016 | Hearl et al. |
| 2017/0065712 | A1 | 3/2017 | August et al. |

FOREIGN PATENT DOCUMENTS

| | | |
|---|---|---|
| JP | 2004537285 A | 12/2004 |
| WO | 2002080851 A2 | 10/2002 |
| WO | 2007065957 A2 | 6/2007 |
| WO | 2010023247 A1 | 3/2010 |
| WO | 2011031298 A1 | 3/2011 |
| WO | 2011046996 A2 | 4/2011 |
| WO | WO 2013187906 A1 * | 6/2012 |
| WO | 2012140627 A1 | 10/2012 |
| WO | 2015200357 A2 | 12/2015 |
| WO | 2017020026 A1 | 2/2017 |

OTHER PUBLICATIONS

Beatty and Gladney (Clin. Canc. Res. 2014, 21(4): 687-692) (Year: 2014).*
Kerkar and Restifo (Cancer Res.2012, 72(13): 3125-3130) (Year: 2012).*
Spranger, S. (Int. Immunol. 2015, 28(8): 383-391) (Year: 2015).*
Nezafat et al (Comput. Biol. Chem. Jun. 2016, 62: 82-95) (Year: 2016).*
Ahmed et al (Neuro-Oncology, Nov. 2016, abstract IMST-31) (Year: 2016).*
Lundstrom (Viruses, 2014, 6: 2392-2415) (Year: 2014).*
Tognon et al (Cancer Genet. Cytogenet., 1996, 90: 17-23) (Year: 1996).*
Yang et al (Neuro-Oncology, Nov. 2016 abstract IMST-33) (Year: 2016).*
Abel et al (Vaccine, 2008, 26: 6013-6025) (Year: 2008).*
Adhikari et al (Front. Oncol. 2022, 12, article 850546, pp. 1-12) (Year: 2022).*
HLA Nomenclature, 2023, 2 pages (Year: 2023).*
Hu et al (Protein Sci., 2007, 16: 2153-2165) (Year: 2007).*

(Continued)

*Primary Examiner* — Michael Szperka
*Assistant Examiner* — Marianne Dibrino
(74) *Attorney, Agent, or Firm* — McNeill PLLC

(57) ABSTRACT

The present invention provides improved LAMP Constructs comprising specific fragments of the LAMP lumenal domain to deliver cancer antigens to immune cells for enhanced processing. These LAMP Constructs can be used for the treatment of disease and in particular hyperproliferative disorders and/or cancer. The improved LAMP Constructs allow for presentation of properly configured three dimensional epitopes for production of an immune response when administered to a subject. The improved LAMP Constructs can be multivalent molecules, and/or can be provided as part of a multivalent vaccine containing two or more LAMP Constructs. The improved LAMP Constructs as described herein can also be used to generate antibodies when administered to a non-human vertebrate.

23 Claims, 61 Drawing Sheets

Specification includes a Sequence Listing.

(56) References Cited

OTHER PUBLICATIONS

Wieczorek et al (Front. Immunol. 2017, vol. 8, article 292: 1-16) (Year: 2017).*

International Preliminary Report of Patentability dated Nov. 14, 2019 and received in PCT/US2018/30725, 9 pages.

Wei et al., "Enhancement of DNA Vaccine Efficacy by Targeting the Xenogeneic Human Chorionic Gonadotropin, Survivin and Vascular Endothelial Growth Factor Receptor 2 Combined Tumor Antigen to the Major Histocompatibility Complex Class II Pathway", The Journal of Gene Medicine, vol. 14, pp. 353-362, (2012).

Written Opinion and International Search Report mailed Aug. 20, 2018 in PCT/US2018/030725, 17 pages.

Arruda et al., "Dendritic Cell-Lysosomal-Associated Membrane Protein (LAMP) and LAMP-1-HIV-1 Gag Chimeras Have Distinct Cellular Trafficking Pathways and Prime T and B Cell Responses to a Diverse Repertoire of Epitopes," J Immunology, 2006, 177: 2265-2275.

Arterburn et al., "The Disulfide Structure of Mouse Lysosome-associated Membrane Protein 1," J. Biol. Chem., 1990, 265:7419-7423.

Carlsson et al., "Structure of Human Lysosomal Membrane Glycoprotein 1, Assignment of Disulfide Bonds and Visualization of its Domain Arrangement," J. Biol. Chem, 1989, 264(34):20526-205311.

De Arruda et al. "DNA vaccine encoding human immunodeficiency virus-1 Gag, targeted to the major histocompatibility complex II compartment by lysosomal-associated membrane protein, elicits enhanced long-term memory response," Immunology, 2004, 112(1):126-33.

Godinho et al., "Regulation of HIV-Gag Expression and Targeting to the Endolysomal /Secretory Pathway by the Luminal Domain of Lysosomal-Associated Membrane Protein (LAMP-1) Enhance Gag-Specific Immune Response," PLOS ONE, 2014, 9(6): e99887.

International Preliminary Report of Patentability mailed Oct. 31, 2019 and received in PCT/US2018/028753, 9 pages.

Official foreign office action issued for the corresponding EP Patent Application No. 18726576.4 on Nov. 16, 2020, 6 pages.

Wilke et al., "Crystal Structure of the conserved domain of the DC lysosomal associated membrane protein: implications for the lysosomal glycocalyx," BMC Biol., 2012, 10:1-15.

Wimer-Mackin et al., "Transmembrane Domain Mutations Influence the Cellular Distribution of Lysosomal Membrane Glycoprotein A," Biochemical and Biophysical Research Comm., 1996, 229(2):472-478.

Written Opinion and International Search Report mailed Jun. 26, 2018 in PCT/US2018/028753, 16 pages.

Zhang et al., "Enhancement of Antitumor Immunity Using a DNA-Based Replicon Vaccine Derived from Semliki Forest Virus," PLoS ONE, 2014, 9(3): e90551.

Zhou et al., "Lamp-2a Facilitates MHC Class II Presentation of Cytoplasmic Antigens," Immunity, 2005, 22(5):571-581.

* cited by examiner

Figure 2A

| Gene Name Accession No. | Alternative Names | SEQ ID NO. | Orthologs | Lumenal Domain ||||| Transmembrane Domain | Cytoplasmic Tail |
|---|---|---|---|---|---|---|---|---|---|---|
| | | | | Signal Seq. | First Homologous domain | Hinge Region | Second Homologous Domain | | | |
| h. LAMP-1 NP_005552.3 | CD107a; LAMPA; LGP120 | 1 | SEQ ID NO: 6-24 | 1-28 | 29-194 | 195-227 | 228 to 381 or 382 | | 382 or 383 to 405 | 406-417 |
| h. LAMP-2 NP_002285.1 | CD107b; LAMPB; LGP110 | 2 | SEQ ID NO:25-43 | 1-28 | 29-192 | 193-228 | 229-375 | | 376-399 | 400-410 |
| h. LAMP-3 NP_055213.2 | CD208; DC LAMP; DC-LAMP; DCLAMP; TSC403 | 3 | SEQ ID NO:44-55 | 1-27 | 28-219 | 220-234 | 235-381 | | 382-402 | 403-416 |
| LIMP-2 Q14108 | AMRF; EPM4; LGP85; CD36L2; HLGP85; LIMPII; SR-BII; SCARB2 | 4 | SEQ ID NO:56-66 | *5-27 Transmem. *Uncleavable | | 28-433 ||| 434-459 | 460-478 |
| h. Endolyn NP_006007.2 | Sialomucin CD164 MUC-24 | 5 | SEQ ID NO:73-79 | 1-23 | | 24-162 ||| 163-183 | 184-197 |
| Macrosailin NP_001242.2 | CD68 | 80 | SEQ ID NO: 81-92 | 1-21 | | 22-319 ||| 320-344 | 345-354 |

Figure 2A cont.

| | | | SEQ ID NO: | | | | |
|---|---|---|---|---|---|---|---|
| LAMP5 NP_036393 | BD-LAMP | 93 | SEQ ID NO: 94-101 | 1-29 | 30-235 | 235-256 | 257-280 |
| h. LIMBIC NP_002329.2 | LSAMP IGLON3 | 67 | SEQ ID NO: 68-72 and 102-113 | 1-28 | 29-315 | 316-338 | No tail |

FIGURE 3: HUMAN LAMP-1 ALIGNMENT WITH ORTHOLOGOUS SEQUENCES

```
              SIGNAL SEQUENCE           LAMP HOMOLOGY DOMAIN 1
                                                  1
SEQIDNO:1   MAAPGSAPPP LLLLLLLLLLGLMH CASA AMHMVKNGN--GTACIMANFSAAFSVNYDTKS  58
SEQIDNO:6   MAAPGAR-RPLL----LLLLAGLAH--GASALFEVK-NN-GTTCIMASFSASFLTTYETAN   52
SEQIDNO:7   ------MARAAG-VCWTLLMGCVFA-AHAVTFEVTDGN---STCIKGELNASFSISYNTTN    50
SEQIDNO:8   -MSWRQVKMPVYWMAVMLLIGVVQ-VATAVQFEVKDGKTNITCILADLSINFSVSYNVSS    58
SEQIDNO:9   MAAPGSARRPLLLLLLLLLLGLVH-CASAAMFMVKNGN-GTACIMANFSASFSVNYDTKS    58
SEQIDNO:10  MAAPGSARRSLLL-LLLLLLGLTH-CASAAMFIVKNGN-GTACIMANFSAAFSVNYDTKS    57
SEQIDNO:11  MAAFGGARPRPL--LLLLLAGLVH--GAAAVFVVKDAN-GTACIMANFSAAFLASYETRS    55
SEQIDNO:12  MEAPGGAPRPLLLL----LLLGLVH--GASAVFVVRNSN-GTACIMANFSAVFSVIYESKS   54
SEQIDNO:13  MAAPGGARRRPLLL--LLFAGLVH--GASAVFVVKNGN-GTACIMADFSATFLTSYDTRS    55
SEQIDNO:14  MAAPGAR-RPLL----LLLLAGLAH--SAPALFEVKDNN-GTACIMASFSASFLTTYDAGH   53
SEQIDNO:15  --------MGGAA--RAVLLGFL---QASSSFDVRDST-GKVCIIANLTVAFSVEYKSSG    46
SEQIDNO:16  MAAPGGAWRRPLLLL-LLLLGLAR--GASAVFVVSDGN-GTACIMADFAAAFEISYDSRS    56
SEQIDNO:17  MAEPGGARTPQRLL--LLLLGLIH--VASSIFVVKNGT-GTACIMANFSATFSMNYTTKS    55
SEQIDNO:18  --------MARALL--AAVLLGFL---QASSSFDVRDST-GKVCIIANLTVAFSVEYKSNG   47
SEQIDNO:19  ------MARGLLA--AAALLGFL---QASSSFEVKDSS-GKVCILADLTVAFSVEYKTNV    48
SEQIDNO:20  MVSSSSCRRGLLL--AAVLLGFL---QASSTFEVRDKT-GKICILANFSAEFTVDYSTKA    54
SEQIDNO:21  MKSFPSFVALFI-VCSAVLADT----QAVVTLEVKEGN--STCIKAEFSAVFSITYNTTN    53
SEQIDNO:22  MKRSHALVVL-I-IAWFSLSGC-----IQAVSLEVKEGN--STCIKANLSAYFSITYNTSS   52
SEQIDNO:23  MTRTCPFVVG-I-AC-FAILGCVTVVQSQVTLEVTEGN--STCIKAELSASFSITYDTAN    55
SEQIDNO:24  ------------------------------------------------------------   0

LAMP HOMOLOGY DOMAIN 1
                                          2
SEQIDNO:1   GPKNMTFDLPSDATVVLNRSSCGKENTSDPSLVIAFGRGH--TLTLNFTRNATRYSVQLM   116
SEQIDNO:6   GSQIVNISLPASAEVLKNGSSCGKENVSDPSLTITFGRGY--LLTLNFTKNTTRYSVQHM   110
SEQIDNO:7   GTSVSVFALPASASVSE-RSSCGS-AAVPPELALVFGDTHTHTLSLLFSRDQRLYRVSNI   108
SEQIDNO:8   KMELATFVLPSEAVTNINKSSCGVENTTAPVLAIQFGSNH--SLSIHFARNNTRYEVAEL   116
SEQIDNO:9   GPKNMTFDLPSDATVVLNRSSCGKENTSDPSLVIAFGRGH--TLTLNFTRNATRYSVQLM   116
SEQIDNO:10  GPKNMTFDLPSDAKVVLNSSSCGKENTSDPSLVIAFGRGQ--TLTLNFTRNATRYSVQLM   115
SEQIDNO:11  GPKNVTFDLPSDA-VVLNSSSCGKENTSDPSLMIAFGKGH--GLTLNFTRNATRYSVQLM   112
SEQIDNO:12  GYKNASFELPATA-EVQNTSSCGRENTSNPSLQIAFGRGH---VLALNFTRNATLYSVPLL  111
SEQIDNO:13  GPQNKSFELPAGA-EVSNSSSCGKENASDSSLVITFGRGH--TLTLIFTRNATRYEVQLM   112
SEQIDNO:14  VSKVSNMTLPASAEVLKNSSSCGEKNASEPTLAITFGEGY--LLKLTFTKNTTRYSVQHM   111
SEQIDNO:15  QKQFAHFFLPQNATSQ-SHSSCGEGNTSHPILALSFGAGH--LISLNFSKTLDKYQVEEL   103
SEQIDNO:16  GAKNTTFSLPASA-QVLNSSSCGKENTSDSSLVIAFGRGH--TLTLSFTRNATRYSVQLM   113
SEQIDNO:17  GLESTTFRLPQNA-SVMNSSSCGKENTSNPILEIGFGGGH--TLTMNFSSTTQSYQVELL   112
SEQIDNO:18  QKQFAHFFLPQNATSQ-SHSSCGEGNTSHPILALSFGAGH--LLSLNFSKTLDKYQVEEL   104
SEQIDNO:19  QKEFVHFFLPQNASVD-SQSSCGKDNASHPILVLDFGGGH--SLSLNFSESADKYQVEEL   105
SEQIDNO:20  KVERKTFQLPSSAHINKESSSCGKEKETSQVLVVEFGTGN--SLTFTFEKSNDFYHVSNL   112
SEQIDNO:21  DTRTVSVFLPNSTTVDSANSSCGS-NGSTPGLMAKFGPGH--YFGMNFSTNGSLYSVDTL   110
SEQIDNO:22  STRTAQFILPDSATVDPDSSTCGG-NGSSPWLVAVFGAGH---ALGLGFSTNGSFYSVANL  109
SEQIDNO:23  GTRTVMVPLPGSAVVGV-ASSCGG-DGRSPWLVALFGDGH--ALGLGFSSNDSLYSVAKL   111
SEQIDNO:24  ------------------------------------------------------------   0
```

FIGURE 3 cont.

```
                             LAMP HOMOLOGY DOMAIN 1
                                          3
SEQIDNO:1   SFVYNLSDTHLFPNASSK-DIKT-VESITDIRADIDKKYRCVSGTQVHMNN-VTVTLHDA   173
SEQIDNO:6   YFTYNLSDTEHFPNAISK-EIYT-MDSTTDIKADINKAYRCVSDIRVYMKN-VTVVLRDA   167
SEQIDNO:7   SLQYNLSDGDIFPQSSSAGVQSVMASVSELMSARLNSTYRCVSSSSISLSAAVNLTLSGV   168
SEQIDNO:8   VMSYNLSDKIIFPNASENGTKTV-STNKTAVLAENDTVYKCMNPHLIRMDN-ANATFHDI   174
SEQIDNO:9   SFVYNLSDTHLFPNASSK-EIKT-VESITDIRADIDKKYRCVSGTQVHMNN-VTVTLHDA   173
SEQIDNO:10  SFVYNLSDTHLFPNASSK-EIKT-VESITDIRADIDKKYRCVSGTQVHMNN-VTVTLHDA   172
SEQIDNO:11  SFIYNLSDTQIFPNASSK-ETKT-VESATDIRADINKKYRCVSNTQIHMHN-VTVTFHDV   169
SEQIDNO:12  SFVYNLSDSDLFPNASSK-DIKT-VGSTTDIKADIDKRYRCVSDSKVPMGN-VTVTLQDA   168
SEQIDNO:13  RFAYNLSDTDTFPNSSST-GVKT-VESATDIKADINKTYRCVSETQVNMDN-VTVTLRDA   169
SEQIDNO:14  YFTYNLSDTQFFPNASSK-GPDT-VDSTTDIKADINKTYRCVSDIRVYMKN-VTIVLWDA   168
SEQIDNO:15  TFHYNLSDETLFPNATEG-KVMV-ATQKSVIQARIGTEYRCINSKYVRMKH-VNITFSNV   160
SEQIDNO:16  TLVYNLSDAEFFPSASSK-GTKT-VAASTDIRADLNTKYRCVSNSQVHLLN-VTVTLGNA   170
SEQIDNO:17  SFSYNLSDATLFPNASKGSEESS-VKSKTDIQADIHKKYRCVSSNRITMSN-VTIVLSDV   170
SEQIDNO:18  TFHYNLSDETLFPNASEG-KVME-VTQKSVIQARIGTEYRCINSKYIYIRH-VNITFSNV   161
SEQIDNO:19  VFHYNLSDATLFPNSSTG-GMKT-VSHKSIIQAHMGTQYRCINSKHINMKN-VNVTFSNV   162
SEQIDNO:20  TFSYNLSDSSFFPNSSG--GQRE-VSRAGDIQANINTTYRCRSNHRVNMTN-VTVLFSNV   168
SEQIDNO:21  FLRYNLSDASLFPEANSSGPVDFELSASVGIWAPTNTTYRCLSPTTITITR-PSVTFSEM   169
SEQIDNO:22  TLQYNLSDASVFPDANSSGVVTV-VSSSVGIWAAVNTTYRCLSSVLFQVGG-ATVTFSDM   167
SEQIDNO:23  TLQYNLSDVSNFPEANSTDVVTVE-TTSVGMVARVNTTYRCISASPVIVGG-ATVTFSNV   169
SEQIDNO:24  ------------------------------------------------------------     0

LAMP HOMOLOGY DOMAIN 1                      Hinge Region
                              4
SEQIDNO:1   TIQAYLSNSSFSRGETRCEQDRPSPTTAPPAP-------------PSP-SP---SPVPKSPS   218
SEQIDNO:6   TIQAYLSSGNFSKEETHCTQDGPSPTTGP----------------PSP-SP----PLVPTNPT   209
SEQIDNO:7   QMEAYMSSANLSADESVCSADQPSTTVAPPPSTT---------------TSPPPIPPVPE   213
SEQIDNO:8   RLEAYLKQSNFSQKVSTCSEDITPTSAPA-PV---T------T-------TAPVPAP-VPDPP   219
SEQIDNO:9   TIQAYLSNSSFSRGETRCEQDRPSPTTAPPAP-------------PSP-SP---SPVPESPS   218
SEQIDNO:10  TIQAYLSNSSFSREETRCEQDRPSPTTAPPAP-------------PSP-SP----SPVPESPS  217
SEQIDNO:11  TIQAYLANSNFSKEETRCEQDGPFPTTAPPPP-------------PHP-SP---SPAPESPS   214
SEQIDNO:12  TIQAYLWNNSFSQAESRCRQDMPSPTTAPPAPPVP------PSPPSP-SP---PPKPESPS   219
SEQIDNO:13  AIQAYLSSSNFSREETRCEQDLPT----------P------TTPPQP-AP---TPAPASPA   210
SEQIDNO:14  TIQAYLPSSNFSKEETRCPQDQPSPTTGP----------------PSP-SP---PLVPTNPS   210
SEQIDNO:15  TLEAYPTNDTFSANKTECREDMVSTTTVAPTTPKH-----ATSQVPTTSPAPTAAPSSPA   215
SEQIDNO:16  TIQAYLANNSFSQQETRCEQDKPSP--------PTP-------TAPPTP-TP---TPAPTSPV   214
SEQIDNO:17  TIQAYLSNNTFSKEETRCSQDTPSPSPVPTTHPTT-----IPVPTP-TPTRPPTPAEIPP   224
SEQIDNO:18  TLEAYPTNGTFSTNKTECSEDMVSTTTVAPTTPKH-----ITSQVPATSPAPTAAPSNPA   216
SEQIDNO:19  TLEAYLTNGTLSVNKTECAEDRVSTTTMVPTTPKQ------TTSQSPTTGPAPTS--PPNPT   216
SEQIDNO:20  TLEAYLPNNAFSKNDSVCAEDKTSTVA--PPITTH-----IPTTTSLAPPT-PPPTDTPK   220
SEQIDNO:21  KLEAYMPGNDFSPAERVCAADQTTTGAPTTTT---------SAATP-TT-PSPTPAGTPE   218
SEQIDNO:22  RLEAYMPGNDLSPRESFCAADQTTTAPPTTTAAP-----TTTAATTM-AP-PAPTPPGTPV   221
SEQIDNO:23  TMEAFMTGEDLSPNESVCTADQSFTTAPPPPPS----------TTTAA-PA-PVPTPPGTPS   219
SEQIDNO:24  -------------MVQICRVQSWFVGVTPLLIFATVLHQGFATVAP-PTPAPHKEPGRPE    46
                                *  :                                    *
```

FIGURE 3 cont.

```
                  Hinge              LAMP HOMOLOGY DOMAIN 2
                          1                                    2
SEQIDNO:1     VDKYNVSGTNGT-CLLASMGLQLNITYE-RKDNTTVTRLLNINPNKTSASGSCGAHLVTL  276
SEQIDNO:6     VSKYNVTGNNGT-CLLASMALQLNITYL-KKDNKTVTRAFNISPNDT-SSGSCGINLVTL  266
SEQIDNO:7     RGNYSVTDGNGTVCVLALMGLQLNITHT-TTQNQSVSELMNLQPNQTTVSGSCGVTESSL  272
SEQIDNO:8     VVQYSVNRSSEP-CLLAKVGLQMNITYT-TKDGKNGSYVFNIESKGVTVDGNCTNTTAYL  277
SEQIDNO:9     VDKYNVSGTNGT-CLLASMGLQLNLTYE-RKDNTTVTRLLNINPNKTSASGSCGAHLVTL  276
SEQIDNO:10    VDKYNVSGTNGT-CLLASMGLQLNLTYE-RKDNTTVTRLLNINPNKTLASGSCGAHLVTL  275
SEQIDNO:11    VHKYNVSGANGT-CLLASMGLQLNVTYK-KKDNTTVVKVVSINPNKTTAGGSCGAQLVTL  272
SEQIDNO:12    VSRYNVSDGNAT-CLLASMGLQLNLTYV-HRDNATVTRVFNINPNKTKPSGHCGAQQVTL  277
SEQIDNO:13    VFRYNVSGSNGT-CLLASMGLQLNVTYR-RVDNKTVTREFNVNPNKTTFGGNCSATLATL  268
SEQIDNO:14    VSKYNVTGDNGT-CLLASMALQLNITYM-KKDNTTVTRAFNINPSDK-YSGTCGAQLVTL  267
SEQIDNO:15    VGKYNVTGANGT-CVLASMGLQLNITYV-KKDEKMGLDLLNFIPHNTSASGMCESTSAFL  273
SEQIDNO:16    VSRYNVSGANGT-CLLASMGLQLNVTYR-TKDNTTVTRGLNINPNKTTFGGSCSAQLVTL  272
SEQIDNO:17    IFKYNVSDANGT-CLLASMGLQLNITYA-KKDNSSARIIWNINPNKTVAGGSCSPQVAIL  282
SEQIDNO:18    VGKYNVTGANGT-CVLASMGLQLNITYL-KKDGKTGLDLLNFVPHNTNASGTCENTSAFL  274
SEQIDNO:19    VGKYNVTGPNGT-CVLAYMGLQLNITYQ-QKDEKMGLDLLNFVPHNTTSSGRCDNTSALL  274
SEQIDNO:20    IGRYNVTGLHGI-CLLATMGLQVNVTYS-TKNKTSKSELLNLPP-TAEVSGTCENSSITL  277
SEQIDNO:21    QGSYSVKNASGTVCLMAKMGVQLNVSYFSQSQNKTVQELLNLTPNLTSSSGLCGGTNATL  278
SEQIDNO:22    RGTYSVVNGNDTTCLLAQMGLQLNVSYFSRSQNKTVQSLVNLTPNLTNSTGSCEKGSATL  281
SEQIDNO:23    QGSYSVSNSNGTVCLLARMALQLNISHFSASQNKTIQEVVNLLPNQTTSSGSCDPTSATL  279
SEQIDNO:24    RGYYNVTNHNGTICLMAYMGLQLNISYNSTSQKKVVQDVMNLQPNLTKHSGLCDSDIASL  106
                *.*          *::*  :.:*:*::::   :          ..      * *       *

LAMP HOMOLOGY DOMAIN 2

SEQIDNO:1     ELHS-EGTTVLLFQFGMNASSSRFFLQGIQLNTTLP-DARDPAFKAANGSLRALQATVGN  334
SEQIDNO:6     KVEN-K-NRALELQFGMNASSSLFFLQGVRLNMTLP-DALVPTFSISNHSLKALQATVGN  323
SEQIDNO:7     RLSD--ETTNLTFSFTMNSTTQKYYLSAVSVSALWP-DMS-VVFEAGNTSLSALQCSVGR  328
SEQIDNO:8     SLST-GS-IDLRFNFTLNSSLEVFYLDGVSLSTGLPADANDTHFEAANSSLNYMQTNVHK  335
SEQIDNO:9     ELHS-EGSTVLLFLFGMNASSSRFFLQGIQLNTTLP-DARDPAFKAANGSLRALQATVGN  334
SEQIDNO:10    ELHS-EGSTVLLFQFGMNASSSRFFLQGIQLNTTLP-DARDPAFKAANSLRALQATVGN   333
SEQIDNO:11    ELRS-ESVTLLAFQFGMNASTSRFFLQGIQLNMTLP-DARDPTFKAGNNSLRALQATIGN  330
SEQIDNO:12    ELQS-ERSTVLVFQFGMNASSGQYFLQGVLLNTTLP-DAREPAFSASNSSLRALQATLGN  335
SEQIDNO:13    ELHS-ENLLLLALQFVMNESSSRVFLQGVQLNLTLP-DAKEGSFTATNSSLRALQATAGN  326
SEQIDNO:14    KVGN-K-SRVLELQFGMNATSSLFFLQGVQLNMTLP-DAIEPTFSTSNYSLKALQASVGN  324
SEQIDNO:15    NLAF-EK-TKITFHFVLNASSEKFFLQGVNVSTTLPSEAKAPTFEASNDSMSESRATVGN  331
SEQIDNO:16    ELQG-ESLRLLALQFALNTSSSRVFLQGVQLNMTLP-DARDPSFSAANSSLRALQATAGN  330
SEQIDNO:17    ELQT-EN--STLAFSFGMNATTSKFFLREIRFHKFFP-DAKDPAFGAVNSSLKELQATVGN  339
SEQIDNO:18    NLAF-EK-TKITFHFVLNASSEKFFLQGVNVSTTLPSEAKAPMFEASNDSMSELRATVGN  332
SEQIDNO:19    NLTF-EK-TRVIFQFALNATAEKFFLQGVSVSTTLPSEAKNPKFEATNNSMSELRASVGN  332
SEQIDNO:20    NLTS-ES-TSLSFQFSQNTSTEKYFLQGIIVTANLPPEATEKNISYSNHTLNALKTSVGK  335
SEQIDNO:21    VLAQ-EETTVLSFLFTVNSTSNKYHLSGITLQANWT-DMM-SPFSASNTSLDYLRSSLGH  335
SEQIDNO:22    ILTQ-Q-TTILIFTFSLNSTSSKYHLSGLSLQANWS-DMA-AAFSASNASLSYLRSTFGH  337
SEQIDNO:23    VLTQ-ANATNLSFLFTLNSTSNRYHLTGLSVVAAWS-DMT-APFNTSNSSLDYQRGSLGR  336
SEQIDNO:24    NLTVDAVKTNLTFVFTMNSTSNKYHLSEVTVSAAWP-EMK-EPVSVHNSSLDYLRGTVGY  164
                :      :  :*   * :    .*  :.     :       .   * ::    :  .
```

FIGURE 3 cont.

```
                    LAMP HOMOLOGY DOMAIN 2              Trans. Domain
                  3                                 4
SEQIDNO:1    SYKCNAEEHVRVTKAFSVNIFKVWVQAFKVEGGQFGSVEECLLDENSMLIPIAVGGALAG   394
SEQIDNO:6    SYKCNTEEHIFVSKMLSLNVFSVQVQAFKVDSDRFGSVEECVQDGNNMLIPIAVGGALAG   383
SEQIDNO:7    SYVCSAQQMLSVTPVFSINTFRLQLQPFNITANRFSTAEECRVDQENMLIPIIVGAALAG   388
SEQIDNO:8    SFKCNSKQTLQITDPFTVNTYHLQVQAFNSD-NTFASAVECSLDENGMLVPIVVGAALAG   394
SEQIDNO:9    SYKCNAEEHVRVTKAFSVNIFKVWVQAFKVEGGQFGSVEECVLDENNMLIPIAVGGALAG   394
SEQIDNO:10   SYKCNAEEHVRVTKAFSVNIFKVWVQAFKVEGGQFGSVEECLLDENNMLIPIAVGGALAG   393
SEQIDNO:11   SYKCNAGEHVQVTEAFSVNIIKVWVQAFQVQGDKFGSVEECQLDENSMLIPIAVGGALAG   390
SEQIDNO:12   SYKCNSEEHVRVTPAFSLSIFKVWVQAFQVKGDKFGSVEECLLDQDSMLIPIAVGGALAG   395
SEQIDNO:13   SYKCNAEQRLRVTSSFSLNMFRVWLQAFRVDGDKFGPVEECQLDENSMLIPIAVGGALAG   386
SEQIDNO:14   SYKCNSEEHIFVSKALALNVFSVQVQAFRVESDRFGSVEECVQDGNNMLIPIAVGGALAG   384
SEQIDNO:15   SYKCSAEENFQVTDKALVNVFNVQVQAFKVDGDKFGAMEECQLDENNMLIPIIVGAALAG   391
SEQIDNO:16   SYKCRSEQRLQVTEAFALNVFQVRVQAFRVDGDKFGPAEECQLDENSMLIPIAVGGALAG   390
SEQIDNO:17   SYKCNAEENVHVTDGFSVNIFRVRVQAFKVEGDKFGSVEECLLDENNMLIPIAVGGALAG   399
SEQIDNO:18   SYKCSAEENLQVTDKALVNVFNVQVQAFKVDGDKFGAVEECQLDENNMLIPIIVGAALAG   392
SEQIDNO:19   SYKCSSEENLQVTDQALVNVFNVQVQIFKIDGDKFGPVEECQLDENNMLIPIIVGAALAG   392
SEQIDNO:20   SYKCIAEESIWISGKAAVNIFNIQLQAFKIPGDKFGAVEECQLDENNMLIPIIVGAALAG   395
SEQIDNO:21   SYMCNAEQTLFVVSTFSINMFELQVQPFGVTSTQFASAEVCQIDQDQMLIPIIVGAALAG   395
SEQIDNO:22   SYMCNAEQILAVTPVFSLNTFSLQIQPFGVTTNQFAAAEECQMDQDQMLIPIIVGASLAG   397
SEQIDNO:23   SYMCISEQTLVVDQNFSLNTFQLQVQPFGITRGQFAQAEECQLDQDNMLIPIVVGAALAG   396
SEQIDNO:24   SYFCRDEQTLNVAQNLSINTFQLQVQPFAVKGDQFGAAEECQLDEDDMLIPIVVGAALAG   224
             *: *      : . :         :.      : :* *     *.     *   * : **:** **.:***

Cytoplasmic Tail
SEQIDNO:1    LVLIVLIAYLVGRKRSHAGYQTI   417
SEQIDNO:6    LVLIVLIAYLIGRKRSHAGYQTI   406
SEQIDNO:7    LVLIVLVAYLIGRKRTHAGYQTI   411
SEQIDNO:8    LVLIVLIAYLIGRKRSHAGYQTI   417
SEQIDNO:9    LVLIVLIAYLVGRKRSHAGYQTI   417
SEQIDNO:10   LVLIVLIAYLVGRKRSHAGYQT-   415
SEQIDNO:11   LVLIVLIAYLIGRKRSHAGYQTI   413
SEQIDNO:12   LVLVVLIAYLIGRKRSHAGYQT-   417
SEQIDNO:13   LVLIVLLAYLIGRKRSHAGYQTI   409
SEQIDNO:14   LVLIVLIAYLIGRKRSHAGYQTI   407
SEQIDNO:15   LVLIVLIAYLIGRKRSHAGYQTI   414
SEQIDNO:16   LVLVVLMAYLVGRKRSHAGYQTI   413
SEQIDNO:17   LVLIVLIAYLIGRKRSHAGYQTI   422
SEQIDNO:18   LVLIVLIAYLIGRKRSHAGYQTI   415
SEQIDNO:19   LVLIVLIAYLIGRKRSHAGYQTI   415
SEQIDNO:20   LVLIVLIAYLIGRKRSHAGYQTI   418
SEQIDNO:21   LVLIVLIAYLIGRKRSHAGYQTI   418
SEQIDNO:22   LVLIVLIAYLIGRKKSHAGYQTI   420
SEQIDNO:23   LVLIVLIAYLIGRKRSHAGYQTI   419
SEQIDNO:24   LVVIVLLAYLIGRKRSHAGYQSI   247
             **::**:***:***::*****:
```

FIGURE 3 cont.

| LAMP-1 | | | | | |
|---|---|---|---|---|---|
| Accession No. | Species | SEQ ID NO: | Accession No. | Species | SEQ ID NO: |
| NP_005552.3 | H. sapiens | 1 | NP_990614.1 | G. gallus | 15 |
| NP_034814.2 | M. musculus | 6 | NP_001011507.1 | S. scrofa | 16 |
| NP_955996.1 | D. rerio | 7 | XP_001374132.1 | M. domestica | 17 |
| NP_001087042.1 | X. laevis | 8 | XP_003203252.1 | M. gallopavo | 18 |
| NP_001233491.1 | P. troglodytes | 9 | XP_002191607.2 | T. guttate | 19 |
| XP_001087801.1 | M. mulatta | 10 | XP_003218797.1 | A. carolinensis | 20 |
| XP_534193.2 | C. lupus familiaris | 11 | XP_004067118.1 | O. latipes | 21 |
| XP_002723509.1 | O. cuniculus | 12 | XP_003969941.1 | T. rubripes | 22 |
| NP_001068592.1 | B. taurus | 13 | NP_001158846.1 | S. salar | 23 |
| NP_036989.1 | R. novegicus | 14 | XP_003452974.1 | O. niloticus | 24 |

FIGURE 4: HUMAN LAMP-2 ALIGNMENT WITH ORTHOLOGOUS SEQUENCES

```
SEQIDNO:2      ----------------------------------------------------------  0
SEQIDNO:25     ----------------------------------------------------------  0
SEQIDNO:26     ----------------------------------------------------------  0
SEQIDNO:27     ----------------------------------------------------------  0
SEQIDNO:28     ----------------------------------------------------------  0
SEQIDNO:29     ----------------------------------------------------------  0
SEQIDNO:30     ----------------------------------------------------------  0
SEQIDNO:31     ----------------------------------------------------------  0
SEQIDNO:32     ----------------------------------------------------------  0
SEQIDNO:33     ----------------------------------------------------------  0
SEQIDNO:34     ----------------------------------------------------------  0
SEQIDNO:35     ----------------------------------------------------------  0
SEQIDNO:36     ----------------------------------------------------------  0
SEQIDNO:37     MAMKNFTLQQERDTSVALIIRTYVRAFLKVYTKVPKPQRCHNQW---QSLNIEGIEGIEI  57
SEQIDNO:38     ----------------------------------------------------------  0
SEQIDNO:39     ---------------------------MECREGEVTRCKQKNNLFSGIN-DDISGAKQ  30
SEQIDNO:40     ----------------------------------------------------------  0
SEQIDNO:41     ----------------------------------------------------------  0
SEQIDNO:42     ----------------------------------------------------------  0
SEQIDNO:43     ----------------------------------------------------------  0

SEQIDNO:2      ----------------------------------------------------------  0
SEQIDNO:25     ----------------------------------------------------------  0
SEQIDNO:26     ----------------------------------------------------------  0
SEQIDNO:27     ----------------------------------------------------------  0
SEQIDNO:28     ----------------------------------------------------------  0
SEQIDNO:29     ----------------------------------------------------------  0
SEQIDNO:30     ----------------------------------------------------------  0
SEQIDNO:31     ----------------------------------------------------------  0
SEQIDNO:32     ----------------------------------------------------------  0
SEQIDNO:33     ----------------------------------------------------------  0
SEQIDNO:34     ----------------------------------------------------------  0
SEQIDNO:35     ----------------------------------------------------------  0
SEQIDNO:36     ----------------------------------------------------------  0
SEQIDNO:37     VKGSKWR---SALETIITIQVKRK--------------SQVQKYHPFSLHSECQKTNQE  99
SEQIDNO:38     ----------------------------------------------------------  0
SEQIDNO:39     AKQRQCTPQKPPKRATATLPLQRPPRGIPGPAPAAVAAAVAADRITPSGSHQTRPPEAAR  90
SEQIDNO:40     ----------------------------------------------------------  0
SEQIDNO:41     ----------------------------------------------------------  0
SEQIDNO:42     ----------------------------------------------------------  0
SEQIDNO:43     ----------------------------------------------------------  0
```

FIGURE 4 cont.

```
SEQIDNO:2    ---------------------------------------------------------MVCF    4
SEQIDNO:25   ------------------------------------------------------------M    1
SEQIDNO:26   ----------------------------------------------------------MGDT   4
SEQIDNO:27   ----------------------------------------------------------------  0
SEQIDNO:28   ---------------------------------------------------------MVCF    4
SEQIDNO:29   ---------------------------------------------------------MVCF    4
SEQIDNO:30   ---------------------------------------------------------MVCF    4
SEQIDNO:31   ---------------------------------------------------------MVCF    4
SEQIDNO:32   ---------------------------------------------------------MVCF    4
SEQIDNO:33   ---------------------------------------------------------MVCF    4
SEQIDNO:34   ---------------------------------------------------------MVCF    4
SEQIDNO:35   ---------------------------------------------------------MVCF    4
SEQIDNO:36   -----------------------------------------------------------MR    2
SEQIDNO:37   G---TGGVATVIADECLLWPSIPFSTLAQKVNLGSCEAFSIIGYSVFALFIYLKPNMLDF    156
SEQIDNO:38   ----------------------------------------------------------------  0
SEQIDNO:39   DERPVRDPRNRAAAPSGHWRRAGGPQRHR------HHR-----------HRRHGPAPLRR    133
SEQIDNO:40   ----------------------------------------------------------------  0
SEQIDNO:41   ----------------------------------------------------------------  0
SEQIDNO:42   ----------------------------------------------------------------  0
SEQIDNO:43   ----------------------------------------------------------------  0

SIGNAL SEQUENCE         LAMP HOMOLOGY DOMAIN 1
                                                            1
SEQIDNO:2    -RL----FPVPGSSGLVLVCLVLGAVR--SYALELNLTDSENATCLYAKWQMNFTVRYETT    57
SEQIDNO:25   -CL----SPVKGAKLILIFLFLGAVQ--SNALIVNLTDS-KGTCLYAEWEMNFTITYETT    53
SEQIDNO:26   GAM--ERCACPAAVLLLSLVL----MG--ATAFEVEIKDDKNATCIYAKLSVNITVQYETD    57
SEQIDNO:27   ---------MAVRGFLPLLFILLSGIVHADDMMTSPLPS-----------------TAELK    35
SEQIDNO:28   -RL----FPVPGSGLVLVCLVLGAVQ--SYALELNLTDSGKATCLYAKWQMNFTVRYETT    57
SEQIDNO:29   -RL----FPVPGSGLVLVCLVLGAVQ--SYALELNLTDSGKATCLYAKWQMNFTVRYETT    57
SEQIDNO:30   -RL----FPVPGSGLVLVCLVLGAVR--SHALELNEADSAIN-------------------    39
SEQIDNO:31   -RL----SPAPGSGLVLLCLVLGAVS--SYALEVNVTDSEKATCLYAKWQMNFTIQYNTT    57
SEQIDNO:32   -RL----SPVPGSGLVLLCLVLGAVS--SYALELNLTDSEKALCLYAKWQMNFTIPYETT    57
SEQIDNO:33   -RL----APVPGSGFLLLCLVLGAVS--SYALELNLTDSSNATCLYAKWQMNFTIRYETT    57
SEQIDNO:34   -RL----SPVPGSGLLMLCLVLGAVS--SYALELNLTNSEKATCLYAKWQMNFTIRYETT    57
SEQIDNO:35   -RL----APVPGCGFLLFCLVLGTVS--SYALELNLTDSSKATCLYAKWQMNFTIRYETT    57
SEQIDNO:36   -LL----SPVTGSKLVLLFLFLGAVR--SDALKLNLTDS-KGTCLYAEWEMNFTITYEAL    54
SEQIDNO:37   IELAELMLSTETQLLEPTRVCCGICQ--SYALEINLTDSKNATCLYSKWQMTFTINYETT    214
SEQIDNO:38   --MAPPRCPAGLALLLLLLGACGFFQ--SYAVEVDVKDASNFTCLYAQWMMKFLIKYETN    56
SEQIDNO:39   LLLRPPP-PAA-----AAARFLGFFQ--SYAVEVDIKDASNATCLYADWMMRFLIKYESN    185
SEQIDNO:40   ---M--ERCACPAALLLLSLVL----MG--AMAFDVEIKDDKNATCIYAKLSVNVTVQYETN    51
SEQIDNO:41   --------MF-RCAFLILFLALGNELHLSHGTEVSVNNTENKLCLYANLMVNFSVTYEVG    51
SEQIDNO:42   ------MKVSHATAGLVVWFVVLGCIDAVT-----L-EVKESNTTCIKADLSASFSIIYNTT    50
SEQIDNO:43   ----------------------------------------------------------------  0
```

FIGURE 4 cont.

```
                              LAMP HOMOLOGY DOMAIN 1
                                         2
SEQIDNO:2   NKTYKTVTISDH--GTVTYNGSICGDDQNGPKIAVQFGPGFS-WIANFTKAA---STYSI 111
SEQIDNO:25  NQTNKTITIAVP--DKATHDGSSCGDDRNSAKIMIQFGFAVS-WAVNFTKEA---SHYSI 107
SEQIDNO:26  TSSSKNITFPVP--SDVTTNGSSCGSDGKAPLLVINFGNSQS-WSLNFTRNN---STYSG 111
SEQIDNO:27  ---T-----ANLP--LVIQTTSSTTSTTTT-SRP---SSTSTHSTLTTEPAA--------- 73
SEQIDNO:28  NKTYKTVTISDR--GTVTYNGSICGDDQNGPKIAVQFGPGFS-WIANFSKAA---STYSI 111
SEQIDNO:29  NKTYKTVTISDR--GTVTYNGSICGDDQNGPKIAVQFGPGFS-WIANFSKAA---STYSI 111
SEQIDNO:30  CSKCKTVTISDH--GTVTYNGSICGDDQNGPKIAVQFGPGFS-WIANFTKAA---STYSI 93
SEQIDNO:31  SKNFKTATISDF--STATYNGSVCGNDQNNPKIVVQFGSGFS-WIVNFTKKE---SAYLI 111
SEQIDN0:32  SKSYKTVTISNF--GTPTYNGSICGDNQNGSRIAVQFGSGFS-WIVNFTKSV---SVYSI 111
SEQIDNO:33  DKHNKTVPISDL--GAATYNGSFCGDDQNGPKIAVQFGSGFS-WIVNFTKEAASPSTYLV 114
SEQIDNO:34  NNSHKTVSISDF--GAATYNGSFCGDDHNDPQIVMQFGSGFS-WIVNFAKES---SSYLI 111
SEQIDNO:35  DKHNKTVTISDF--DAAAYNGSVCGDDQNGPKIAVQFGSGFS-WIVNFTKEASSTSTYLV 114
SEQIDNO:36  K-VNETVTITVP--DKVTYNGSSCGDDKNGAKIMIQYGSTLS-WAVNFTKEA---SQYFI 107
SEQIDNO:37  GNETKNVTVTVP--ENVTYDGSSCGDNQTVPQIAVQFGLGYS-WHLNFTKKEN--NSYSF 269
SEQIDNO:38  SSDYKNASLDLT--STVTHNGSICGSDTQAALLAVQFGDGHS-WSINFTKNN----ETYRA 110
SEQIDNO:39  SGDYKTTTLNLS--SSVTHNGSVCGNDTQAALVAVQFGEGHS-WSINITKNN---ETYQG 239
SEQIDNO:40  TSSTKNVTFSVP--SEVTTNGSSCGSNGKAPILVINFGNGHS-WSLNFTRND----SMYSG 105
SEQIDNO:41  VNKNETVIFVLP--ENVTTEGSTCDNTTSTLKL--SFGHGHS-WTVEFTKKN---KTYQV 103
SEQIDNO:42  HAER-TVQVLLPNSTTVDTANSTCGKDGSSPRLVAVFGSGY-TLGLNFSTNG---TLYQV 105
SEQIDNO:43  ------------------------------------------------------------  0

LAMP HOMOLOGY DOMAIN 1
                                         3
SEQIDNO:2   DSVSFSYNTGDNTFPDAEDKGI-ITVDELLAIRIPLNDLFRCNSLSTLEKNDVVQHYWI 170
SEQIDNO:25  HDIVLSYNTSDSTVFPGAVAKGV-HTVKNPENFKVPLDVIFKCNSVLTYNLTPVVQKYWG 166
SEQIDNO:26  SALIFTYNTNDTILFPDALRKGLIS-STAMFLGPVPLNSTYKCISREVVVSENVTQIIYD 170
SEQIDNO:27  ----------------------KTTTARTTVTTSA---PTSTQSTSSSSTSATVTTLAP 107
SEQIDNO:28  DSISFSYNTGDNTTFPDAEDKGI-ITVDELLAIKIPLNDLFRCNSLSTLEKNDVVQNYWD 170
SEQIDNO:29  DSISFSYNTGDNTTFPDAEDKGI-ITVDELLAIKIPLNDLFRCNSLSTLEKNDVVQNYWD 170
SEQIDNO:30  DSISFSYNTGDNTTFPDAEDKGI-LTVDELLAIKIPLNDLFRCNSLSTLEKNDVVQHYWD 152
SEQIDNO:31  DSISFSYNLSDNATFPDAKEKGI-LTVHDLVGFRIPLNNIFRCNSLSTLEKNGVVQYYWD 170
SEQIDN0:32  DSISFSYNTGDNTTFPDAKDKGI-LTVNESVAFKIPLNDIFRCNSLSSLVKNGVVQNYWD 170
SEQIDNO:33  DTISFSYNTNDNKTFPDAKEKEV-FTVNNRVALKIPLNDIFRCNSLSTLENRDVVQHYWD 173
SEQIDNO:34  NSISFSYNTSDTTTFPDAKKKGV-LTVNDSVGFQVPLNDIFRCNSLSTLEKDNVVQHYWD 170
SEQIDNO:35  DSISFSYNTNDNATFPDAKEKGV-FTVNNRVALKIPLNDIFRCNSLSTLEKSDVVQHYWD 173
SEQIDNO:36  NNITLSYNTNDTKTFPGAVPKGI-LTVIIPVGSQLPLGVIFKCSSVLTFNLSPVVQHYWG 166
SEQIDNO:37  DTIVFTYNTSDNETFPEAKEKGQVLSVFEFRYARIPLNKIFRCHSEESLIGDKATHHYWE 329
SEQIDNO:38  EFITFTYNTNDTAVFPDARRQGPVTIVVKDAMHPIQLNNVFVCHHTTSLEAENVTQIFWN 170
SEQIDNO:39  DFITLTYNTNDTAVFPDAKRKGPITVLVRDPSRPIQLNTVFVCHNSFVIEAENTTQIFWN 299
SEQIDNO:40  GALIFTYNTNDSTLFPDALKEGLIS-STAAFLGPIPLNSTYKCISSEVVVSENVTQIISD 164
SEQIDNO:41  DTIVFSYNLNDSSVFPNSTSKETKFVTVKSIITNVSVDTYYSCKSENVLTVESVIQTLYD 163
SEQIDNO:42  SSLTLQYNLSDTSVFPNATISGVVTLVSASVGIEANVNTTYKCASPTVIDVATAKVNFTD 165
SEQIDNO:43  -------------------------------------------MTQIGGVQPVFLA 13
```

FIGURE 4 cont.

```
              LAMP HOMOLOGY DOMAIN 1            Hinge Region
                           4
SEQIDNO:2    VLVQAFVQNGTVSTNEFLCDKDKTS---TVAPTIHTTVPS------PTTTPT--PKEKPE   219
SEQIDNO:25   IHLQAFVQNGTVSKNEQVCEEDQTP--TTVAPIIHTTAPSTTTTLTPTSTPTPTPTPT   224
SEQIDNO:26   VKLEAFMANGTLGK-EIICDADKPS---PVPSPTQPST-----TASTAIPAPTSKPLDKPT   222
SEQIDNO:27   TTTGHNTTNSTTEPPTTTGHNTTNS--TTDAPTTTHTNAT----VAPTPPPTTPSVPKPT   161
SEQIDNO:28   VLVQAFVQNGTVSTNEFLCDEDKTS---TVAPTIHTTVPS------PTTTPT--PKEKPE   219
SEQIDNO:29   VLVQAFVQNGTVSTNEFLCDEDKTS---TVAPTIHTTVPS------PTTTPT--PKEKPE   219
SEQIDNO:30   VLVQAFVQNGTVSTNEFLCDKDKTS---TVAPTVHTTVPS------PTTTPT--RIP---   198
SEQIDNO:31   VHVQAFVQNGTVSTKEFLCEKDKTS---TTVVPTISTTTPS------PTTTPT--PKEKPE   220
SEQIDNO:32   VHVQAFVQNGTVSTNEYLCEKDNTT--TTVAPIVPTTVPSPTTTSSPTTTPS--PKEKPD   226
SEQIDNO:33   VHVQAFVQNGTVSTTEFLCDKDKTV--TTAVPIVPTTLPS-------PT---------KPV   216
SEQIDNO:34   VHVQAFVQNGTVSTKEFLCDKDKTL--TTTVPVIPTSVPS------PTTTPT--PKEKPE   220
SEQIDNO:35   VHVQAFVQNGTVSTTEFLCDKDKTV--TTAMPIVPTTAPS-----PT---------KPV   216
SEQIDNO:36   IHLQAFVQNGTVSKHEQVCKEDKTA--TTVAPIIHTTVPSPTTTLTPTSI-----PVPTPT   220
SEQIDNO:37   TVVQAFIQNGTISKEEFICSKDRAS--TTVAPVTTQVVPS---------TTATPVPQDKPY   379
SEQIDNO:38   VTMQPFVQNGTISKKESRCYADTPTAAPTVLPTVANVTTAS-TTISPAPTTAPKPAENPV   229
SEQIDNO:39   VTMQAFVQNGTVSKKESRCPADTPTSEPTVPPTIANVTTASTTTLSPAPTTAPKPVENPV   359
SEQIDNO:40   VKLEAFMQNGTLGK-EVSCDADKPS--PTPT-TNPST-----TASTTTPTPTSKPLDNPT   215
SEQIDNO:41   VALQAFVINGSKSDTDTVCSADMTS---TTVAPTT----TV----TSTAAPTSTPTLPTPT   213
SEQIDNO:42   MRLEAYMPGNELSPNETVCFADQTS---TTPSPTTVSTTAV----PTQT-----P--PGTPQ   213
SEQIDNO:43   VTVHLIL--------ATV--LHQTF--AT---VTPPVTTA----VPHK----E--PGRPD    48

Hinge           LAMP HOMOLOGY DOMAIN 2
                             1                        2
SEQIDNO:2    AGTYSVNNG--NDTCLLATMGLQLNITQ------DKVASVININPNTTHSTGSCRSHTAL   271
SEQIDNO:25   VGNYSIRNG--NTTCLLATMGLQLNITE------EKVPFIFNINPATTNFTGSCQPQSAQ   276
SEQIDNO:26   MGNYTVSDA--SGICLLASMGLQINTSLL--SEGKNIWRPFNIDPLGIKTNGTCTNQTGT   278
SEQIDNO:27   VGNYSVKTD-NVSDCLLAKMGLQFSFKIS----GNASLQTVNLDPNVTKVNGTCGSGGSD   216
SEQIDNO:28   AGTYSVNNG--NDTCLLATMGLQLNITQ------DKVASVININPNTTHSTGSCRSHTAL   271
SEQIDNO:29   AGTYSVNNG--NETCLLATMGLQLNITQ------DKVASVININPNTTHSTGSCRSHTAL   271
SEQIDNO:30   ---------------------------------PXVASVININPNTTHSTGSCRSHTAL   224
SEQIDNO:31   VGSYSVNNS--NGTCLLATMGLQLNITH------NKVASVININPNTTDFTGSCQPQTAL   272
SEQIDNO:32   VGSYLVKNG--SDTCLLATMGLQLNVTH------DKVASVININPNVTGYSGSCHPQTAL   278
SEQIDNO:33   VGSYSVVNS--NGTCLLATMGLQLNITH------DKVASVFNINPNTTNATGSCQPQTAL   268
SEQIDNO:34   TGSYSVTSS--NGTCLLANMGLQLNITQ------DKVASVININPNTTNATGNCHSKTAL   272
SEQIDNO:35   VGSYSVVNS--NGTCLLATMGLQLNITH------DKVASVFNINPNTTNATGSCQPQTAL   268
SEQIDNO:36   VGNYTISNG--NATCLLATMGLQLNITE------EKVPFIFNINPATTNFTGSCQPQTAQ   272
SEQIDNO:37   PGKYAVKNG--NDTCLLATMGLQLNVTQ------NKVNSVININPNVTDFTGSCSNETAE   431
SEQIDNO:38   TGNYSLKTG--NKTCLLATVGLQLNISQ------DK-PLLINIDPKTTHADGTCGNTSAT   280
SEQIDNO:39   TGNYSLKSG--NKTCFLATVGLQLNVSQ------EK-PLLININPKTTVADGACGNTTAT   410
SEQIDNO:40   TGNYSVSDV--NGTCLLASMGLQINTSLL--SEGKNIWTAFNIDPTAMSKNGTCSNQTGT   271
SEQIDNO:41   TGKYSIAPDVNSTACLMATFGLQIGYKQG----D---KEETINLVPNITEVGGACGANSS-   266
SEQIDNO:42   QGNYTVKDA-NDTICLLAKMGLQLNVSYT--SQNKTVQDVLNLNPNVTNSTGSCGASSAT   270
SEQIDNO:43   QGDYQVTSS-NGTVCFLASMGLQLNITFNSTSQNKTLQEVINIQPNRTKSSGSCDTSSAL   107
                                                    .*:  *      *  *       .
```

FIGURE 4 cont.

```
                   LAMP HOMOLOGY DOMAIN 2
SEQIDNO:2    LRLNS-STIKYLDFVFAVKNE-----NRFYLKEVNISMY-LVNGSV-FSIANNNLSYWDAP  324
SEQIDNO:25   LRLNN-SQIKYLDFIFAVKNE-----KRFYLKEVNVYMY-LANGSA-FNISNKNLSFWDAP  329
SEQIDNO:26   LILTE--NRTIIEFTFALKNK-----NHFYLEEVNITLI----NGSAFSSRQNQNLSTWEAS  329
SEQIDNO:27   SSLFLTS--KDITVHFVFTNDS---QKFRLHALTLTVD-LGNG-NIFNDSNTNLSLWEAS   269
SEQIDNO:28   LRLNS-STIKYLDFVFAVKNE-----NRFYLKEVNVSMY-LVNGSV-FSIANNNLSYWDAP  324
SEQIDNO:29   LRLNS-STIKYLDFVFAVKNE-----NRFYLKEVNVSMY-LVNGSV-FSIANNNLSYWDAP  324
SEQIDNO:30   LRLNS-STIKYLDFVFAVKNE-----NRFYLKEVNISMY-LVNGSV-FSIANNNLSYWDAP  277
SEQIDNO:31   LRLNS-SNIKYLDFVFAVKNE-----NRFYLKEVNVSMY-LVNGSV-FSIANNNLSYWDAP  325
SEQIDNO:32   LRLNS-SNIKYLDFVFAVKNE-----NRFYLKEVNVSMY-LANGSV-FSFANNNLSYWDAP  331
SEQIDNO:33   LRLSS-SNIKYLDFVFAVKNE-----NRFYLKEVNVSMI-LVNGSV-YSISNTNLSYWDAP  321
SEQIDNO:34   LRLSG-SNIKYLDFVFAVKND-----NRFYLKEVNVSVY-LVNGSV-FSIANNNLSYWDAP  325
SEQIDNO:35   LRLSS-SNIKYLDFVFAVKNE-----NRFYLKEVNVSMI-LVNGSV-YSISNTNLSYWDAP  321
SEQIDNO:36   LRLNN-SQIKYLDFIFAVKNE-----KRFYLKEVNVNMY-LANGSA-FHVSNNNLSFWDAP  325
SEQIDNO:37   LRLSG-SNVKYIDFIFAVKNG-----NRFYLKEVNVSIS-FVNASD-LNVANNNLSYWDAP  484
SEQIDNO:38   LKLND-GNRTLIDFTFIV-NASASVQKFYLREVNVTLLNYQNGSVILSADNNNLSKWDAS   338
SEQIDNO:39   LKLND-GNSTLIGFTFAVKNTSASVQKFYLREVNVTLLNRLNGSVISSADNSNLSKWDAF   469
SEQIDNO:40   LILTD--NSTVIEFTLALKNK-----NHFYLKEVNVALI---NGSASSTRQNQNLSAWEAS  322
SEQIDNO:41   -DLILTS---DTITIMFTFSNDG----KKFHLALKVTVK-PATG-DPVIAVNNNMSIWAAA  318
SEQIDNO:42   LVLTQ-TQSTILTFNFTLNSTT----NKYHLSGVTLIAN-WFDS-AHFSMSNNSLNYLRST  324
SEQIDNO:43   LTLTTDAEKTNLTFVFALNTTS---NKYHLSEVSLSAA-LSDMKETFVAQNHSLDYLRGT   163
                  *        : . : . .        ::: *  :.:              * .:.     .

LAMP HOMOLOGY DOMAIN 2                        Trans. Domain
                              3                       4
SEQIDNO:2    LGSSYMCNKEQTVSVSGAFQINTFDLRVQPFNVQGKYSTAQDCSADL-DNFLVPIAVGA   383
SEQIDNO:25   LGSSYMCNKEQVLSVSRAFQINTFNLKVQPFNVTKGQYSTAQECSLDDD-TILIPIIVGA  388
SEQIDNO:26   VDSSYMCHKEQQIKVSEDLFINAFDVRVQPFGVNNGTFATAEDCFAD-Q-NFIVPIVVGA  387
SEQIDNO:27   VGSSYMCRKEQSYNISDKLTLNTFELQVQPFDVKKNSFSTAHECSLDDT-SLLIPIIVGA  328
SEQIDNO:28   LGSSYMCNKEQTVSVSGAFQINTFDLRVQPFNVTQGKYSTAEECSADSDLNFLIPVAVGV  384
SEQIDNO:29   LGSSYMCNKEQTVSVSGAFQINTFDLRVQPFNVQGKYSTAQDCSADD-DNFLVPIAVGA  383
SEQIDNO:30   LGSSYMCNKEQTVSVSGAFQINTFDLRVQPFNVTQGKYSTAEECSADSDLNFLIPVAVGV  337
SEQIDNO:31   LGSSYMCNKEQTVSVSGAFQINTFDLRVQPFNVMEGKYSTAQECSLDDD-TILIPIIVGA  384
SEQIDNO:32   LGSSYMCNKEQTVSVSGEFQINTFDLRVQPFNVKDGKYSTAQDCRADD-DNFLVPIAVGA  390
SEQIDNO:33   LGSSYMCNKEQTVSVSGAFQINTFDLRVQPFSVTEGKYSTAQECSLDDD-TILIPIIVGA  380
SEQIDNO:34   LGSSYMCNKEQTVSVSGAFQINTFNLRVQPFSVMEGKYSTAQDCSADD-DNFIVPIAVGA  384
SEQIDNO:35   LGSSYMCNKEQTVSVSGALQINTFDLRVQPFSVTEGKYSTAEECSADSDLNFLIPVAVGV  381
SEQIDNO:36   LGSSYMCNKEQVVSVSRTFQINTFNLKVQPFNVTKGEYSTAQDCSADED-NFLVPIAVGA  384
SEQIDNO:37   LGSSYMCNKEQTLALADSLQINTFNLRVQPFSVVAGKYSTAEDCSADDD-NFIVPIAVGA  543
SEQIDNO:38   LGNSYMCRKEQTLEINENLQVHTFNLWVQPFLVKENKFSIAEECFADSDLNFLIPVAVGM  398
SEQIDNO:39   LGSSYMCRKEQTLQINENVQVHTFNLWIQPFLVEANKFATAEECIADSDLNFLIPIAVGV  529
SEQIDNO:40   VGSSYMCHKEQQIKVSEDLVINSFDVRVQLFGVKNETFATAQQCSLDDD-SIVIPIVVGA  381
SEQIDNO:41   VGSSYMCNKEQTLNVTDTLTLYTFELRVQPFEVNKGEFATAHECSLDDT-SILIPIIVGA  377
SEQIDNO:42   LGYSYMCNAEQTLFVTPSFSLNTFDLQVQPFGVKSGRFATAEEECQMDQN-QMIIPIIVGA  383
SEQIDNO:43   LGFSYMCRERQTLGVTPDFAINTFQVQVQPFGVTGKQFAAAEECQLDKD-DMLIPIIVGA  222
               :. **** . * :    .:.:*::  :* * *      :: *.:*  *    :::*: **
```

FIGURE 4 cont.

```
                    Cytoplasmic Tail
SEQIDNO:2   ALAGVLILVLLAYFIGLKHHH-AGYEQF  410
SEQIDNO:25  GLSGLIIVIVIAYLIGRRKTY-AGYQTL  415
SEQIDNO:26  ALGVLVVLVMVAYFIGRRKQSSAGYEQM  415
SEQIDNO:27  ALAGLIFIVVIAYVIGRRRTY-VGYQTL  355
SEQIDNO:28  ALGFLIIVVFISYMIGRRKSR-TGYQSV  411
SEQIDNO:29  ALAGVLILVLLAYFIGLKRHH-AGYEQF  410
SEQIDNO:30  ALGFLIIVVFISYMIGRRKSR-TGYQSV  364
SEQIDNO:31  GLSGLIIVIVIAYLIGRRKSY-AGYQTL  411
SEQIDNO:32  ALAGVLILVLLAYFIGLKRHH-AGYEQF  417
SEQIDNO:33  GLSGLIIVIVIAYLIGRRKSY-AGYQTL  407
SEQIDNO:34  ALAGVLILVLLAYFIGLKRHH-AGYEQF  411
SEQIDNO:35  ALGFLIIVVFISYMIGRRKSR-TGYQSV  408
SEQIDNO:36  ALGGVLILVLLAYFIGLKRHH-TGYEQF  411
SEQIDNO:37  ALGGLVILVLMAYFVGRKRRA-TGYEQF  570
SEQIDNO:38  ALGFLIILVFISYIIGRRKSR-TGYQSV  425
SEQIDNO:39  ALGFLIILVFISYIIGRRKSR-TGYQSV  556
SEQIDNO:40  ALAGLIVIIVIAYLIGRRKGY-SGYQTL  408
SEQIDNO:41  ALAGLILIVVIAYVIGRRKTY-VGYQTL  404
SEQIDNO:42  ALAGLVLITLIAYLIGKRRSH-AGYQAI  410
SEQIDNO:43  ALAALVLIVLSAYLIGRKRSH-AGYQSI  249
             .*. ::.:  . :*.:* ::    **: .
```

| | LAMP-2 | | | | |
|---|---|---|---|---|---|
| Accession No. | Species | SEQ ID NO: | Accession No. | Species | SEQ ID NO: |
| NP_002285.1 | H. sapiens | 2 | NP_001231184.1 | S. scrofa | 34 |
| NP_034815.2 | M. musculus | 25 | XP_004022401.1 | O. aries | 35 |
| NP_001087881.1 | X. laevis | 26 | NP_058764.2 | R. norvegicus | 36 |
| NP_001013551.1 | D. rerio | 27 | XP_001510101.2 | O. anatinus | 37 |
| XP_003918270.1 | P. Anubis | 28 | NP_001001749.1 | G. gallus | 38 |
| XP_001084005.2 | M. mulatta | 29 | XP_002191794.1 | T. guttata | 39 |
| XP_003317709.1 | P. troglodytes | 30 | NP_001116192.2 | X. tropicalis | 40 |
| XP_005641822.1 | C. lupus familiaris | 31 | NP_001133282.1 | S. salar | 41 |
| XP_001493687.3 | E. caballus | 32 | XP_003445830.1 | O. niloticus | 42 |
| NP_001029742.1 | B. Taurus | 33 | XP_003961835.1 | T. rubripes | 43 |

FIGURE 5: HUMAN LAMP-3 ALIGNMENT WITH ORTHOLOGOUS SEQUENCES

```
                 SIGNAL SEQUENCE              LAMP HOMOLOGY DOMAIN 1

SEQIDNO:3    MPRQLSAAAALFASLAVILHD----GSQMRAKAFPETRDYSQPTAAATVQDIKKPV-QQP    55
SEQIDNO:44   MPRQLSAAAALFASLAVILHD----GSQMRAKAFPETRDYSQPSAAATVQDIKKPV-QQP    55
SEQIDNO:45   MPRQLSAAAVLFASLAVILHD----GSQMRAKAFPKTRDYSQPTAAATGQDIAKPV-QQP    55
SEQIDNO:46   MPRQLSAAAVLFASLAVILHD----GSQMRAKAFPKTRDYSQPTAAATGQDIAKPV-QQP    55
SEQIDNO:47   MSWQLSAAVALFVSLALILHY----GSQIRAKMFPETVDFQ-PTTAATVRATAKPFL-HL    54
SEQIDNO:48   MSWRLSAVLVSFVSLAVFLHY----GHHMKAKVFPEITDSSSPTTAATVQATAEPSLWKP    56
SEQIDNO:49   ------------------------------------------------------------     0
SEQIDNO:50   MAWQLSAVVVLFVSLAVILYY----GSHVRANVFPEITDYSQPTTAATIQTRAQPSLSQP    56
SEQIDNO:51   MSWQIPAVVMSFMALVAIWYYDSHYNSHMQAKVFPEITGYSSPTTG---QATVKPSLLQP    57
SEQIDNO:52   MSWQISAVVLFFVSLAVIWYYDS----HMKANVFPEITGYSSPTTG---QATVKPSLLQP    53
SEQIDNO:53   MPGQTSAVAVL-LCLAVILH-----GYQIREKEFPEARGYLQYTATTTEQITAKPPL-PL    53
SEQIDNO:54   MPGQISAVAVLFLSLTVILH-----GYQIREKEFPKARGYLQYTATSAEQITTKPLL-QL    54
SEQIDNO:55   ------------------------------------------------------------     0

LAMP HOMOLOGY DOMAIN 1

SEQIDNO:3    AKQAPHQTLAARFMDGHITFQTAATVKIP-------------TTTPATTKNTATTSPITY   102
SEQIDNO:44   AKQAPHQTLAARFMDGHITFQTAATVKTP-------------TTTPATTKNTATTSPITY   102
SEQIDNO:45   ANQAPHQTLAARLMDGHITFQTAATIKTP-------------TTTPVTTKNTPTTSPIIY   102
SEQIDNO:46   ANQAPHQTLAARLMDGHITFQTAATIKTP-------------TTTPVTTKNTPTTSPIIY   102
SEQIDNO:47   TNQVPSQTLAARSMDGHIASQRAATTSSSEPPTTHTTVKTLVTTSLVTANSTPSSSPIIY   114
SEQIDNO:48   TNHTPHKTLAAKSTDGHVTSQIATTVTDSETLTTHTTITTLAATSLAATNSTPSTSPTTH   116
SEQIDNO:49   ------------------------------------------------------------     0
SEQIDNO:50   TNQVPHKTLATRSMDGQVTSQTAATTVNPETPVTHTTIKTAAATSLVTTNSTLSTSPITN   116
SEQIDNO:51   TNYVPHKTAAARSTDGHVTSQTVAKTSSSETLTTNTTIDVLATTSPVTTKSTLPTTPTTH   117
SEQIDNO:52   TNHVPCNTAAAKSTDGHVTSQTVAKTSSPETLTTNTTIEVLVTTSPVTTQSTLPTTPTTH   113
SEQIDNO:53   TNQTSHATLASRSKDDYIQTAAETS--TFE-----DTAHITMKTAIPVTTKSLLPISSTSY  107
SEQIDNO:54   INQRSHITLASRFKDDYIQMAAETS--AIE----NTAHITMKTVTPVTTKSLPPISSASY   108
SEQIDNO:55   ---------------------------------------MDRVSLLSTILLLY          14

LAMP HOMOLOGY DOMAIN 1

SEQIDNO:3    TLVT--------TQATPNNSHTAPPVTEVTVGPSLAPYSLPPTI---TPPAHTTGTSSSTV   152
SEQIDNO:44   TLVT--------TQATPNNSHTAPPVTEVTVGPSLVPYSLPPTI---TPPAHTTGTSSSTV   152
SEQIDNO:45   TLVT--------TQATSNNSHTAPPLTKVTVGPSLAPYSLPPTI---TPPAHTTGTSSSTV   152
SEQIDNO:46   TLVT--------TQATSNNSHTAPPLTKVTVGPSLAPYSLPPTI---TPPAHTTGTSSSTV   152
SEQIDNO:47   TLVT--------TIVTPNNSNTAAPVTEATIGPSADPGSLPTTS--TPLAHTTRTNPSTL    164
SEQIDNO:48   TLFT--------TLATPNTSHMAAPVTEAAISPSAGLSSLLPTI---IPPAHTTGTRSSTL   166
SEQIDNO:49   ------------------------------------------------------------     0
SEQIDNO:50   TLLT--------TLATPDNTHTTPVTEATIGPSAGPGSPPTTITTTSSAYTTGTRSSTV    168
SEQIDNO:51   TLVT--------TLATPNKSHVTFPVTEAKVGLSVGPSSPPVTV---NPTAHTTGNRPSTA   167
SEQIDNO:52   TLVT--------TLATPSKSHVTFPVTEAKAGLSIGPSSPPVTI---NPAAHTTGNRPSTA   163
SEQIDNO:53   TFV------------RTNNSHMTASSTEDTIGSGSITHL---------PFPTTRASLAAV   146
SEQIDNO:54   TFV------------RSNNAHMTASSTDDTIGSGSIAHL---------PVPTTRASLAIV   147
SEQIDNO:55   GLLYINDAYSENTFAQPSNTTTPAPNTTTHVTSNTTTLAP-------------NTTT      59
```

FIGURE 5 cont.

LAMP HOMOLOGY DOMAIN 1

```
SEQIDNO:3   SHTTGNTTQPSNQTTLPATLSIALHKSTTGQKPVQP---THAPGTTAAAHNTTRTAAPAS   209
SEQIDNO:44  SHTTGNTTQPSNQTTLPATLSIALHKSTTGQKPVQP---THAPGTTAAAHNTTRTAAPAS   209
SEQIDNO:45  NHTTGNATQPSNQTTLPATLSIALHKSTTGQKPVQP---THAPGTTAAAHNTTRTAAPAS   209
SEQIDNO:46  NHTTGNATQPSNQTTLPATLSIAPHKSTTGQKPVQP---THAPGTTAAAHNTTRTAAPAS   209
SEQIDNO:47  SHKTRKTTHFGNQTTLPATLSTSTHKSTSSHKSAQS---THAPGPTTAAHNTTQTASPAT   221
SEQIDNO:48  SPTAGKTTQPSNQTTLPATLSTSPHNSTASQKPTHP---NHTPGPTTGAHNTTQTASPAT   223
SEQIDNO:49  --------MTQSSRSVLLLMLSSLHCLGSSLESNPKDPSVLAEAPGQN-------KRDSDISL   48
SEQIDNO:50  SHTTGKTTQLSNQTTLPATLSTSPHNSTTSQNPAHS---THTPGPTTGTCNTTQTASPTT   225
SEQIDNO:51  SHTTGKTTQLSNQTTLPATLSTSPHNITTSQKPTQP---THTPGPTTATYNTTQTASPAT   224
SEQIDNO:52  SHTTGKTTQLSNQTTLPATLSTSPHNITTSQKPTQP---THTPGPTTAANNTTHTASPAT   220
SEQIDNO:53  NHITGRSTQLGGQTTLPKALFTPSHESTTQRPTLS---TI-VSELTPTGKDRSTTSSVP   202
SEQIDNO:54  NYITGRATQLGGQTTLPKTFFTASHKSTTNQRPTLS---TNVLGTSTPTHKDRSTTSPVP   204
SEQIDNO:55  THVTSNTTTLA------PNTTTTHITSNTTTLAPNTT---TTLAPNTTTTHSVTTTKTAST   111
                        *     .                          :
```

Hinge      LAMP HOMOLOGY DOMAIN 2

```
                    1
SEQIDNO:3   TVPGPTLAPQPSSVKTGIYQVLN-GSRLCIKAEMGIQLIVQDKESVFSPRRYFNIDPNAT   268
SEQIDNO:44  TVPGPTLAPQPSSVKTGIYQVLN-GSRLCIKAEMGIQLIVQDKESVSWGHRTITLSS--K   266
SEQIDNO:45  TVPGSTLAPQPSSVKTGIYQVLN-GSRLCIKAEMGIQLIVQDKESVFSPRRYFNLDPNAT   268
SEQIDNO:46  TVPGSTLAPQPSSIKTGIYQVLN-GSRLCIKAEMGIQLIVQDKESVFSPRRYFNLDPNAT   268
SEQIDNO:47  PASGPTLAPQPSSPKTGIYQVLN-GSRLCIKAEMGIELMVQDTKSVFSPQRYFNIDPNAT   280
SEQIDNO:48  IAPGPTLAPQPSSAKTGIYQVLN-GSKLCIKAEMGIELTVQDTQSVFSPQRYFNIDPNTT   282
SEQIDNO:49  VPQMPVLQPKETAPPLVTYTIRNPQGKVCVRASFGVEFVVREN-----KKKYYFNLTPNSA   104
SEQIDNO:50  TAPGPTLAPQPSSAKTGMYQILN-GSKLCIKAEMGIQLTVQDTKSASPPQGYFNIDPNTT   284
SEQIDNO:51  IAPRPTLAPQPLSPKTGIYQVHN-GSKLCIKAEMGIQLTVQDSVSVFSPQKYFNIDPNAT   283
SEQIDNO:52  IAPRPTLAPQPLSPKTGLYQVLN-GSKLCIKAEMGIQLTVQDSVSVFSPQKYFNIDPNAT   279
SEQIDNO:53  LVPRPTFVTWSSPAKIGTYEVLN-GSRLCIKAEMGIALIVQEKGLDSATQRHFNIDPSLT   261
SEQIDNO:54  LVPRPTLVTWSSPAKIGTYEVLN-GSRLCIKAEMGLALIVQEKDLDSATQRYFNIDPSLT   263
SEQIDNO:55  TTPTPTLEPKPSPPETGNYTVKI-KNEFCIEALMGLELELTNS----TKTQQYFNIVPSQI   167
                .:          *  :    ...*:.* :*:  : :  :.   :   :.:
```

LAMP HOMOLOGY DOMAIN 2

```
                2
SEQIDNO:3   QASGNCGTRK----SNLLLNFQGGFVNLTFTKDEESYYISEVGAYLTVS------DPETIY   319
SEQIDNO:44  SLSGGCLARNEHSPHPLFLFFEKGPPSVTQAEDEESYYISEVGAYLTVS------DPETIY   321
SEQIDNO:45  QASGNCGTRN----SNLLLNFQGGFVNLTFTKDEGSYYISEVGACLTVS------DPETIY   319
SEQIDNO:46  QASGNCGTRN----SNLLLNFQGGFVNLTFTKDEGSYYISEVGACLTVS------DPETIY   319
SEQIDNO:47  QTSGNCGSQK----SNLLLNFQGGFVNLTFLKDENSYYINEVGAYLAVS------NPEKIY   331
SEQIDNO:48  QASGNCGSPK----SKLLLNFQGGFVNLTFTKDENSYYVSGVGAYLTVS------NPEKVY   333
SEQIDNO:49  RATGYCANQK----TVLSLEFSGGNLEFTFIKDGDQSYVKTVKGSLRAAPPCKNCPSKIY   160
SEQIDNO:50  QVSGICGSRK----SNLLLNFWGGFVNLTFTKDENSYYISEVGAYLTVS------NPEKTY   335
SEQIDNO:51  QASGNCGSRK----SNLLLNFQGGFVNLTFTKGEKSYYISEVEAYLTVS------NPAKVY   334
SEQIDNO:52  QASGNCGSRK----SNLLLNFQGGFVNLTFIKDENSYYISEVEAYLTVS------NPAKVY   330
SEQIDNO:53  HASGKCGSQN----SNLFLNFQGGSVNVTFTKEENLYYVSEVGAYLTIS------NTEKTY   312
SEQIDNO:54  HASGKCDSQK----SNLFLNFQGGSVNITFTKEENLYYISEVGAYLTIS------NTEKTY   314
SEQIDNO:55  NSNGTCEKSK----ANLNLTFANSYINFVFAQDDNSYYLDNVTVYFNLT------RSESWY   218
                .* *    :     * * *  .  ...  :     *:. *   :   :       . *
```

FIGURE 5 cont.

```
                          LAMP HOMOLOGY DOMAIN 2
                        3                                          4
SEQIDNO:3   QGIKHAVVMFQTAVGHSFKCVSEQSIQLSAHLQVKTTDVQLQAFDFEDDHFGNVDECSSD  379
SEQIDNO:44  QGIKHAVVMFQTAVGHSFKCVSEQSLQLSAHLQLKTTDVQLQAFDFEDDHFGNVDECSSD  381
SEQIDNO:45  QGMKHAVVMFQTAVGHSFKCVSEQSLQLSAHLQLKTTNVQLQAFDFEDDHFGNVDECSSD  379
SEQIDNO:46  QGMKHAVVMFQTVVGHSFKCVSEQSLQLSAHLQLKTTNVQLQAFDFEDDHFGNVDECSSD  379
SEQIDNO:47  QGMKSSVVMFETGVGHSFKCVSEQSIQLSTHLQLKTMNVQFQAFDFEDDHFGNVDECSSD  391
SEQIDNO:48  QGMKNAVVMFETMIGHSFKCVSEQSIQLSPHLQLNTMNVQLQAFDFEDDHFGNVDECSSD  393
SEQIDNO:49  VGLVDNEKLFKAKNGLSFNCKSETMLILADYFRLKLVPLQIQAFDLVNGAFGKEVECWAD  220
SEQIDNO:50  QGMKSPVVMFETVIGHSFKCVSEQSLELSTQLHLKTTNVQLQAFDFEDDNFGNVDECSSD  395
SEQIDNO:51  QGLKHAMMMFETVVGHSFKCVSEQSIQLSTYLQLKTMNVQLQAFDFEDDHFGNADECISD  394
SEQIDNO:52  QGMKYAMMMFETVVGHSFKCVSEQSIQLSNHLQLKTVNVQLQAFDFEDDRFGNADECISD  390
SEQIDNO:53  QGKS-TMMMFETVVGHSFKCVSEQSIQLSAQLQMKTMNIHLQAFDFEGDSFGIVDECLSD  371
SEQIDNO:54  QGKKNTLMMFETVVGHSFKCVSEQSIQLSAQLQMKTMNIHLQAFDFEGDSFGNVNECLSD  374
SEQIDNO:55  GNAT-NQKLLKTENGYSVKCKNTPKIQLGDTMNLVMTNVKLQVFNFKDNSFGKETTCKYD  277
             ,       ::::  * *.:*  .    : *,  :.:     :::*.*:: .. **   *  *

Trns Memb.     Cyto. Tail
SEQIDNO:3   YTIV-LPV-IGAIVVGLCLMGMGVYKIRLRCQSSGYQRI  416
SEQIDNO:44  YTIV-LPV-IGAIVVGLCLMGMGVYKIRLRCQSSGYQRI  418
SEQIDNO:45  YTIV-LPV-IGAIVVGLCLVGIGVYKIRLRCQSSGYQRI  416
SEQIDNO:46  YTIV-LPV-IGAIVVGLCLVGMGVYKIRLRCQSSGYQRI  416
SEQIDNO:47  YTVV-LPV-IGAIVLGLCAVGLIVYGIHLRRESSGYQRI  428
SEQIDNO:48  YTIV-LPV-IGAIVLGLCAVGLIVYGIRLKRESSEYQRI  430
SEQIDNO:49  YNKRMIPIILGAVAAAICLIAILTYVLVREHRNQGYEQL  259
SEQIDNO:50  YTVV-LPV-IGAIVLGLFAVGLIVYGVRVRREASGYQRI  432
SEQIDNO:51  RNRREIPVAVGLSIAVLLAVLLTACLVTRKRPSRGYERM  433
SEQIDNO:52  RNRREIPVAVGLSIAVLLAVLLTACLVTRKRPSRGYERM  429
SEQIDNO:53  YTVV-LPV-VGIIVVVLCVVGLGIYKIRQRRQSSAYQRI  408
SEQIDNO:54  YTVV-LPM-VAIIVVVICVVGLSVYKIRQRHQSSAYQRI  411
SEQIDNO:55  HNFG-LMI-AGIVIVVIVVLGVIIYFIWHKRKSSGYQRI  314
              .  ::  .       :  ::    :  .    *:::
```

| | LAMP-3 | | | | |
|---|---|---|---|---|---|
| Accession No. | Species | SEQ ID NO: | Accession No. | Species | SEQ ID NO: |
| NP_055213.2 | H. sapiens | 3 | XP_001496333.1 | E. caballus | 50 |
| XP_001155195.3 | P. troglodytes | 44 | NP_001095605.1 | B. Taurus | 51 |
| XP_003894825.1 | P. Anubis | 45 | XP_004003158.1 | O. aries | 52 |
| NP_001028044.1 | M. mulatta | 46 | NP_001012015.1 | R. norvegicus | 53 |
| XP_848889.2 | C. lupus familiaris | 47 | NP_796330.2 | M. musculus | 54 |
| XP_003358746.1 | S. scrofa | 48 | XP_002936919.2 | X. tropicalis | 55 |
| XP_001342688.2 | D. rerio | 49 | | | |

FIGURE 6: HUMAN LIMP-2 ALIGNMENT WITH ORTHOLOGOUS SEQUENCES

```
                                                              SIGNAL SEQUENCE
SEQIDNO:4   ------------------------------------------------MGRCCFYTAGTLS 13
SEQIDNO:56  ------------------------------------------------MGRCCFYTAGTLS 13
SEQIDNO:57  ------------------------------------------------MGRCCFYTAGTLS 13
SEQIDNO:58  ------------------------------------------------MGRCCFYTVGTLS 13
SEQIDNO:59  ------------------------------------------------MGRCCFYAVGTLS 13
SEQIDNO:60  ------------------------------------------------MGRCCFYTAGTLS 13
SEQIDNO:61  ----------------------------------------------MTRRSCTIYATGIVC 15
SEQIDNO:62  ------------------------------------------------MARCCFYTAGTLS 13
SEQIDNO:63  ------------------------------------------------MRSLCLVTVGVLA 13
SEQIDNO:64  ------------------------------------------------MVKWAVFGTAAVS 13
SEQIDNO:65  MQLDDILHINNCKADCSSLSTTPNPKTDLVNMNGPKHKFCTKLSSTYLRKWWITIV--VA 58
SEQIDNO:66  ---------------------------MYGRSNRLCAKLSSAFLRKWWFVIA--FA 27
                                                               .  .  ..

LAMP HOMOLOGY DOMAIN

SEQIDNO:4   LLLLVTSVTLLVARVFQKAVDQSIEKKIVLRNGTEAFDSWEKPPLPVYTQFYFFNVTNPE 73
SEQIDNO:56  LLLLVTSVTLLVARVFQKAVDQSIEKKIVLRNGTEAFDSWEKPPLPVYTQFYFFNVTNPE 73
SEQIDNO:57  LLLLVTSVTLLVARVFQKAVDQSIEKKIVLRNGTEAFDSWEKPPLPVYTQFYFFNVTNPE 73
SEQIDNO:58  LLLLVTSIALLVARVFQKAVDQTIEKNIVLRNGSETFDSWKKPPLPVYAQFYFFNVTNPE 73
SEQIDNO:59  LLLLVTSITLLVARVFQKAVDQTIEKNIVLRNGSETFDSWKKPPLPVYTQFYFFNVTNPE 73
SEQIDNO:60  LLLLVTSVTLLVARVFQKAVDQTIEKNMVLQNGTKVFNSWEKPPLPVYIQFYFFNVTNPE 73
SEQIDNO:61  AHLLILGIALLLAQVFQTMIQERIKKEITLAENSRVLDGWINPPPPVYMQYFFFNVTNPD 75
SEQIDNO:62  LLLLVTSVTLLVARVFQKAVDQTIEKNMVLQNGTKVFDSWEKPPLPVYIQFYFFNVTNPE 73
SEQIDNO:63  LTLLIASISLLVAHVFQTVVDLQVKQGTVLKNGTETFEAWEDPPPPVYMQFYFFNVTNPL 73
SEQIDNO:64  VTLLIVSIVLLLTHTFMDIVEGQVKQAIVLKNESEVFEDWANPPPPVYMQFYFFNVTNPL 73
SEQIDNO:65  AALIIG---GIVVACEFTVLIDAVVDRMVALRPGAKTFGWWAKPPVEPRISLYIYNVTNAD 116
SEQIDNO:66  LSLLVL---GALVTFGFTAFIRTIIDHQVALRVGGQSFGWWSRPPVEPIIRIFVYNVTNAD 85
               *::        :::  *    :    :,:   .*   . :   *  **    :,:****

LAMP HOMOLOGY DOMAIN

SEQIDNO:4   EILRGE-TPRVEEVGPYTYRELRNKANIQFGDNGTTISAVSNKAYVFERDQSVGDPKIDL 132
SEQIDNO:56  EILRGE-TPRVEEVGPYTYRELRNKANIQFGDNGTTISAVSNKAYVFERDQSVGDPKIDL 132
SEQIDNO:57  EILRGE-TPRVEEVGPYTYRELRNKANVQFGDNGTTISAVSNKAYVFERDQSVGDPKIDL 132
SEQIDNO:58  EILRGE-IPRLEEVGPYTYRELRDKADIQFGDNGTTISAVSNKAYVFERNQSVGDPKTDL 132
SEQIDNO:59  EILNGE-TPRLEEVGPYTYRELRNKDDIQFGDNGTTISAVSNKAYVFERDKSVGDPKIDL 132
SEQIDNO:60  EILQGE-IPLLEEVGPYTYRELRNKANIQFGENGTTISAVTNKAYVFERNQSVGDPNVDL 132
SEQIDNO:61  EFLAGKEKAKVTQMGPYTYREYRPRENVTYLENGTKIFATNPKSFVFLRNMSAGDPEVDR 135
SEQIDNO:62  EILQGE-IPLLEEVGPYTYRELRNKANVQFGENGTTISAVTNKAYIFERNQSVGDPTVDL 132
SEQIDNO:63  EVLQGA-TPLVEEKGPYTYREYRPRVHVQFLDNGTKVSALNPKTYVFEPEKSVGNPEVDL 132
SEQIDNO:64  EVLSGE-KPFVDEIGPYTYREYRPRENITFSVNGTEVSAVTPKTYVFEPEKSIGDPKVDL 132
SEQIDNO:65  DFLSNGSKAIVDEVGPYVYSETWEKVNIVENDNGTL-SYNLRKIYSFREDLSVG-PEDDV 174
SEQIDNO:66  EFLNNGTKPILDELGPYVYVQTWEKVNIKENPNGTI-SYNQKRVYIFNEDLSGG-LEDDV 143
              :,*  .      : : ***.* :   : .:    ***        :: * : * *     *
```

FIGURE 6 cont.

LAMP HOMOLOGY DOMAIN

```
SEQIDNO:4   IRTLNIPVLTVIEWSQ-V-HFLREIIEAMLKAYQQKLFVTHTVDELLWGYKDEILSLIHV 190
SEQIDNO:56  IRTLNIPVLTVIEWSQ-V-RFLREIIEAMLKAYQQKLFVTHTVDELLWGYKDEILSLIHV 190
SEQIDNO:57  IRTLNIPVLTVIEWSQ-V-HFLREIIEAMLKAYQQKLFVTHTVDELLWGYKDEILSLIHV 190
SEQIDNO:58  IRTLNIPAVTAMEWAH-L-HFFRELIEALLKAYQQTLFVTHTVDELLWGYKDEILSLINV 190
SEQIDNO:59  LRTLNIPALTAMEWTQ-L-PLLRDIIEALLKAYRQKLFVTHTVDELLWGYKDEILSLINT 190
SEQIDNO:60  IRTINIPLLTVVDLAQ-L-TLLRELIEAMLKAYQQKLFVIHTVHELLWGYKDEILSLVHI 190
SEQIDNO:61  VTTVNIPMIAVMNELNSYSFFVRTAVSMYMGSMGMGLFMNRTVHEILWGFKDPLLTKLHA 195
SEQIDNO:62  IRTINIPLLTVVEMAQ-Q-PFLREIIEAMLKAYQQTLFVTHTVHELLWGYKDEVLSLVHI 190
SEQIDNO:63  IRTINVPAVTAMEWTR-A-TSLQFATEVLLLLYQESLFTVRTVHELLWGYKDKLLSTIHV 190
SEQIDNO:64  IRTVNIPLVTILEMTK-DSSLLRPFIIAALKTYKEGMFVTRTVDELLWGYKDAVLSILHP 191
SEQIDNO:65  VIVPNIPMLSATSQSKHAARFLRLAMASIMDILKIKPFVQVSVGQLLWGYEDPLLKLAKD 234
SEQIDNO:66  VIVPNIPMLSATSQSKHAARFLRLAMASIMDILKIKPFVEVSVGQLLWGYEDPLLKLAKD 203
             :  .*:*  ::  . .       .:        :       *   :*  ::***::* :*.  :
```

LAMP HOMOLOGY DOMAIN
                                                                                                    1
```
SEQIDNO:4   FRPDI-----SPYFGLFYEKNGTNDGDYVFLTGEDSYLNFTKIVEWNGKTSLDWWITDKCN 246
SEQIDNO:56  FRPDI-----SPYFGLFYEKNGTNDGDYVFLTGEDSYLNFTKIVEWNGKTSLDWWITDKCN 246
SEQIDNO:57  FRPDI-----SPYFGLFYEKNGTNDGDYVFLTGEDNYLNFTKIVEWNGKTSLDWWITDKCN 246
SEQIDNO:58  FKPEI-----SPYFGLYYGKNGTNDGDYVFLTGEDNYLNFSKIVEWNGKTSLDWWTTDKCN 246
SEQIDNO:59  FKHDV-----SPYFGLFYGKNGTNDGDYVFLTGEDNYLNFSKIVEWNGKTSLDWWTADECN 246
SEQIDNO:60  FKPDV-----SPNFGLFYERNGTNDGEYVFLTGEDNYLNFSKIVEWNGKTSLDWWTTDTCN 246
SEQIDNO:61  MRPEV-----DEHFGLMYNKNGTHEGEFVFHTGEKNYMNYGKIDTWNGISQMNWWSSNQSN 251
SEQIDNO:62  FRPDV-----SPNFGLFYERNGTNDGEYVFLTGEDNYLNFTKIVEWNGKTSLDWWTTDTCN 246
SEQIDNO:63  LHPEI-----DPVFGFFNKMNGTDDGEYVFLSGEMNYLNFSRIVEWKGKESLNWWTTKTCN 246
SEQIDNO:64  FKKNI-----SDTFGLFYKMNTTDDGEYIFLSGEKDYLEFTQIAEWKGQKALNWWTTETCN 247
SEQIDNO:65  VVPKEQKLPYEEFGLLYGKNGTSSDRVTVNTGVDDIRRYGIIDNFNGRTHLPHWTTDACN 294
SEQIDNO:66  VVPKEQKLPYEEFGLMYGKNSTSKDTVTVWTGVDDITQYGIIDKYNGRSHQTHWLSEQCN 263
             . .            **:      * * ..    .:*  . .:   *   ::*        *  :.  .*
```

LAMP HOMOLOGY DOMAIN
                                                  2
```
SEQIDNO:4   MINGTDGDSFHPLITKDEVLYVFPSDFCRSVYITFSDYES-VQGLPAFRYKVPAEILANT 305
SEQIDNO:56  MINGTDGDSFHPLITKDEVLYVFPSDFCRSVYITFSDYES-VQGLPAFRYKVPAEILANT 305
SEQIDNO:57  MINGTDGDSFHPLITKDEVLYVFPSDFCRSVYITFSDYES-VQGLPAFRYKVPAEILANT 305
SEQIDNO:58  MINGTDGDSFHPLIDKDEILYVFPSEFCRSVYITFSDFKS-VQGLPAFRYKVPGEVLANT 305
SEQIDNO:59  MINGTDGDTFHPLITRDEVLYVFPSDFCRSVYITFSDFES-VQGLPALRYKVPAEILANT 305
SEQIDNO:60  MINGTDGDSFHPLISKDEVLYLFPSDLCRSVHITFSSFEN-VEGLPAFRYKVPAEILANT 305
SEQIDNO:61  MINGTDGSVFHTFLSRKELLYIFAADLCRSIHLGYVRDME-VKGIPAFRFAPPSDVLAPP 310
SEQIDNO:62  MINGTDGDSFHPLISKDETLYIFPSDFCRSVYITFSSFEN-VEGLPAFRYKVPAEILANS 305
SEQIDNO:63  MINGTDGTSFHPLISKDENIYIFSSDFCRSLYLVYDSSGS-VAGVPTYRFVPSPMVFANT 305
SEQIDNO:64  MINGTDGTSFHPLLNKDDTIYMFSSDLCRSIYAVYESSEN-IKDISVFRFSPPASVFANV 306
SEQIDNO:65  TLAGTDGSIFPPHIDHDRILHVYDKDLCRLLPLVFEKEVMTSNEVPGYRFTPPEWVFADV 354
SEQIDNO:66  RLNGTDGSIFPPRITKNSTLHVYEKDLCRLLPLSFEKEVTVRGGVKGYRFTPSPDVFASV 323
             : ****   *    :  :.  ::::  ::**  :    :            : *:       ::*
```

FIGURE 6 cont.

```
                                        LAMP HOMOLOGY DOMAIN
                                3            4             5
SEQIDNO:4     ---SDNAGFCIPE-GNCLGSGVLNVSICKNGAPIIMSFPHFYQADERFVSAIEGMHP-NQ 360
SEQIDNO:56    ---SDNAGFCIPE-GNCLGSGVLNVSICKNGAPIIMSFPHFYQADERFVSAIEGMHP-NK 360
SEQIDNO:57    ---SDNAGFCIPE-GNCLGSGVLNVSICKNGAPIIMSFPHFYQADERFVSAIEGMHP-NK 360
SEQIDNO:58    ---SDNAGFCVPK-GNCLGSGVLNISICKNGAPIIISFPHFYEADKKFVSAIDGMRP-NK 360
SEQIDNO:59    ---SDNAGFCIPK-GNCLGSGVLNVSVCKNGAPIIMSFPHFYQADEKFVSAIGGMHP-NK 360
SEQIDNO:60    ---SENAGFCIPE-GNCMDSGVLNISICKNGAPIIMSFPHFYQADEKFVSAIKGMHP-NK 360
SEQIDNO:61    DENPANAGFCVPA-GDCLGKGVLKVSVCRQGAPIVVSFPHFYQADERYINAIEGMNP-NE 368
SEQIDNO:62    ---SENAGFCIPE-GNCMDAGVLNVSICKNGAPIIMSFPHFYQADEKFVSAIKGMRP-NK 360
SEQIDNO:63    TVNPDNAGFCVPP-GNCPGAGVLNVSICKQGAPIFLSAPHFYQADQKFVSDIEGMHP-TK 363
SEQIDNO:64    SVNPQNKGFCVPE-GNCLPSGLLNVSICKEGAPIVLSSPHFYQADENVINSIRGMKP-VK 364
SEQIDNO:65    DSHPDNMCFCPAGKPSCSPNGLFNVSLCYDSPIMLSFPHFYLADESLRTQVEGISPPMK 414
SEQIDNO:66    DKNPNNMCYCPAG--PPCAPHGLFNVSLCQYDSPILLSFPHFYMADQTLRTAVEGISPPEK 382
                       *  :*         *    *:::;*:*:  .:**..:* **** **:     . : *: *    :

LAMP HOMOLOGY DOMAIN
SEQIDNO:4     EDHETFVDINPLTGIILKAAKRFQINIYVKKLDDFVETGDIRTMVFPVMYLNESVHIDKE 420
SEQIDNO:56    EDHETFVDINPLTGIILKAAKRFQINIYVKKLDDFVETGDIRTMVFPVMYLNESVHIDKE 420
SEQIDNO:57    EDHETFVDINPLTGIILKAAKRFQINIYVKKLDDFVETGDIRTMVFPVMYLNESVLIDKE 420
SEQIDNO:58    DYHETFVDINPLTGIILRAAKRFQINVYKKLDDFIETGNIRTMVFPVMYINESVLIDKD 420
SEQIDNO:59    EYHETFVDINPLTGIILRAAKRFQINVYVRKLDDFVETGNIQTLVFPVMYINESVLIDKE 420
SEQIDNO:60    EEHESFVDINPLTGIILRGAKRFQINTYVRKLDDFVETGDIRTMVFPVMYLNESVLIDKE 420
SEQIDNO:61    EEHETYLDINPTTGVPIRACKPAQLNIILKRVRGFPNTKFLNETIFPIMYVNETATIDDE 428
SEQIDNO:62    EEHESFVDINPLTGIILRGAKRFQINTYVKKLDDFVETGNIRTMVFPVMYLNESVLIDKE 420
SEQIDNO:63    EYHETFVDINPLTGLVLQAAKRMQINIHVRKLPEFFETGNIRTLIFPVMYINESVLIDEA 423
SEQIDNO:64    EHHMTFLDLNPLTGTLIQAAKRIQVNVYVRKINVYLITQDIQTLFFPVMHLNESVLIDDK 424
SEQIDNO:65    EKHQFFFDVQPKMGTTLRVRARIQINLAVSQVFDIKQVANFPDIIFPILWFEEGIDNLPD 474
SEQIDNO:66    DKHQLFIDVQPDMGTALRARARIQINLAVSQVVDIKQVANFPDIVFPILWFEEGIDSLPD 442
                : *    :.*::*  *   ::    * *:*    :  ::        . :   .**::  .:*

Trans. Domain            Cytoplasmic Tail
SEQIDNO:4     TASRLKSMINTTLIITNI----PYIIMALGVFFGLVFTWLACKGQGSMDEGTADERAPLI 476
SEQIDNO:56    TASRLKSMINTTLIITNI----PYIIMALGVFFGLVFTWLACKGQGSMDEGTADERAPLI 476
SEQIDNO:57    TASRLKSVINTTLIITNI----PYIIMALGVFFGFVFTWLACKGQGSMDEGTADERAPLI 476
SEQIDNO:58    TASRLKSVINTTLIITNI----PYIVMALGVFFGLIFTWLACRGQGSMDEGTPDERAPLI 476
SEQIDNO:59    TASRLKSVINTTLIVTNI----PYIIMALGVFFGLIFTWLACRGQGSTDEGTADERAPLI 476
SEQIDNO:60    TANQLKSVINTTLVVTNI----PYIIMALGVFFGLVFTWLACRGQGSMDEGTADERAPLI 476
SEQIDNO:61    SAAQMRMLLLIVTVVSNF----PVIILALGVILLVVLIFLVCRNRQRKNEVKRIDFTEAF 484
SEQIDNO:62    TASQLKSVINTTLIVTNI----PYIIMALGVFFGLIFTWLACRGQGSTDEGTADERAPLI 476
SEQIDNO:63    SANKLKHVLLEASVVTGI----PFVIMAIGIVFGIVFSVLVCRAQGAREESTEEERSPLI 479
SEQIDNO:64    SAGRLRSILFQGRVVANI----PFIIMGLGIILAFLFTTLSCLQKRSRDEGTEEERGPLI 480
SEQIDNO:65    EVTDL--MRFAEQVPPKIRVALIVGLCALGVILLLSTF---CLIRNSHRQSTLHLEGSNY 530
SEQIDNO:66    EILDL--MKVATNIPPRAKFILTIALFGLGGFLFVVAVI--CLVRKSHRQSTLHLEGSNY 498
                :     :         :         : ..:* .: .:       *   :     : .
```

FIGURE 6 cont.

```
SEQIDNO:4     RT--------------------------------------------     478
SEQIDNO:56    RT--------------------------------------------     478
SEQIDNO:57    RT--------------------------------------------     478
SEQIDNO:58    RT--------------------------------------------     478
SEQIDNO:59    RT--------------------------------------------     478
SEQIDNO:60    RT--------------------------------------------     478
SEQIDNO:61    HSFATTKDETAYTQVSNQAEDSPENRNNQPLRNGSYIAMSPVEAQKC     531
SEQIDNO:62    RT--------------------------------------------     478
SEQIDNO:63    RT--------------------------------------------     481
SEQIDNO:64    RAS-------------------------------------------     483
SEQIDNO:65    LATA-----------QVDMNKKQNKDNQPARY---------------    551
SEQIDNO:66    LATA-----------SVDQAKKKAKMDNGMSSKSN------------    522
              :
```

| LIMP-2 | | | | | |
|---|---|---|---|---|---|
| Accession No. | *Species* | SEQ ID NO: | Accession No. | *Species* | SEQ ID NO: |
| NP_005497.1 | *H. sapiens* | 4 | NP_775366.1 | *D. rerio* | 61 |
| XP_517214.2 | *P. troglodytes* | 56 | NP_446453.1 | *R. norvegicus* | 62 |
| XP_001096458.1 | *M. mulatta* | 57 | XP_420593.1 | *G. gallus* | 63 |
| XP_005639134.1 | *C. lupus familiaris* | 58 | NP_001016557.1 | *X. tropicalis* | 64 |
| NP_001095623.1 | *B. Taurus* | 59 | NP_726504.2 | *D. Melanogaster* | 65 |
| NP_031670.1 | *M. musculus* | 60 | XP_314345.2 | *A. gambiae* | 66 |

FIGURE 7: HUMAN LIMBIC/SLAMP ALIGNMENT WITH ORTHOLOGOUS SEQUENCES

```
                        SIGNAL SEQUENCE           LAMP HOMOLOGY DOMAIN
                                                           1
SEQIDNO:67     -MVRRVQPDRKQLPLV-LLRLLCL-LPTGLPVRSVDFNRGTDNITVRQGDTAILRCVVED  57
SEQIDNO:68     -MVRRVQPDRKQLPLV-LLRLLCL-LPTGLPVRSVDFNRGTDNITVRQGDTAILRCVVED  57
SEQIDNO:69     -MGARVQPDRKQLPLV-LLRLLCL-LPTGLPVRSVDFNRGTDNITVRQGDTAILRCVVED  57
SEQIDNO:70     --MVGRVQPDRKQLPLV-LLRLLCL-LPTGLPVRSVDFNRGTDNITVRQGDTAILRCVVED 57
SEQIDNO:71     -MVGRSQSDRNQLPLF-LLRLLCL-LPTGLPVRSGDFNRSTDNMTVRQGDTAILRCFVED  57
SEQIDNO:72     -----MSCLWIHSVFIPGFF---LLF-GFEGFPVISVESQRSTDNITIRQGDTTVIRCYVDD  53
SEQIDNO:102    -MVGRVQPDRKQLPLV-LLRLLCL-LPTGLPVRSVDFNRGTDNITVRQGDTAILRCVVED  57
SEQIDNO:103    --MVGRVQPDRKQLPLV-LLRLLCL-LPTGLPVRSVDFNRGTDNITVRQGDTAILRCVVED 57
SEQIDNO:104    -MVARVQPDRKQLPLV-LLRLLCL-LPTGLPVRSVDFNRGTDNITVRQGDTAILRCVVED  57
SEQIDNO:105    -MVARVQPDRKQLPLV-LLRLLCL-LPTGLPVRSVDFNRGTDNITVRQGDTAILRCVVED  57
SEQIDNO:106    -----------MSFAGEAA------SQILNKAEPLFISRSEAFKFAVGDTITLPCEVAS   42
SEQIDNO:107    ------MRPCLLHSIWMLGFVLCLLSLQGLPVRSGDFNRSTDNITVRQGDTAILRCFVED  54
SEQIDNO:108    -MLGARRPPRSQLPLV-LLRLLCL-LPTGLPVRSVDFNRGTDNITVRQGDTAILRCVVED  57
SEQIDNO:109    -MVGRVHPDRKQLPLV-LLRLLCL-LPTGLPVRGVDFTRGTDNITVRQGDTAILRCYVED  57
SEQIDNO:110    -MVARAQPDRKQLPLV-LLRLLCL-LPTGLPVRSVDFTRGTDNITVRQGDTAILRCFVED  57
SEQIDNO:111    ----MRTYW-LHSIWVL-GFFLSLF-SLQGLPVRSVDFTRGTDNITVRQGDTAILRCYVED 54
SEQIDNO:112    ------MRPCLLHSIWMLGFVLCLLSLQGLPVRSGDFNRSTDNITVRQGDTAILRCFVED  54
SEQIDNO:113    MQVGRKSCWRQ---LQASFFRLLCL-IPTGFPVRSVDMQRATDNITIRQGDTAIIRCYVDD 57
                          :          ::  :..  ***   :  * *   .

LAMP HOMOLOGY DOMAIN
                                        2
SEQIDNO:67     KN-SKVAWLNRSGIIFAGHDKWSLDPRVELEKRHSLEYSLRIQKVDVYDEGSYTCSVQTQ  116
SEQIDNO:68     KN-SKVAWLNRSGIIFAGHDKWSLDPRVELEKRHSLEYSLRIQKVDVYDEGSYTCSVQTQ  116
SEQIDNO:69     KN-SKVAWLNRSGIIFAGHDKWSLDPRVELEKRHSLEYSLRIQKVDVYDEGSYTCSVQTQ  116
SEQIDNO:70     KN-SKVAWLNRSGIIFAGHDKWSLDPRVELEKRHALEYSLRIQKVDVYDEGSYTCSVQTQ  116
SEQIDNO:71     KS-SKVAWLNRSGIIFAVDDKWSLDPRVELEKRSPFEYSLRIQKVDVSDEGPYICSVQTN  116
SEQIDNO:72     KV-SKVAWLNRSNIIFAGEDKWSLDPRVELVTQGQLEYSLRIQKVDVFDEGPYTCSIQTK  112
SEQIDNO:102    KN-SKVAWLNRSGIIFAGHDKWSLDPRVELEKRHALEYSLRIQKVDVYDEGSYTCSVQTQ  116
SEQIDNO:103    KN-SKVAWLNRSGIIFAGHDKWSLDPRVELEKRHSLEYSLRIQKVDVYDEGSYTCSVQTQ  116
SEQIDNO:104    KN-SKVAWLNRSGIIFAGHDKWSLDPRVELEKRHSLEYSLRIQKVDVYDEGSYTCSVQTQ  116
SEQIDNO:105    KN-SKVAWLNRSGIIFAGHDKWSLDPRVELEKRHSLEYSLRIQKVDVYDEGSYTCSVQTQ  116
SEQIDNO:106    PGTYVLAWKRGIAILTAGSVKVTPDPRVRLVN----GYSLQIRDAVPQDAGDYICQIAML  98
SEQIDNO:107    RS-SRVAWLNRSGIIFAGDDKWSLDPRVELEKRSLLEYSLRIQKVDVSDEGPYTCSVQTK  113
SEQIDNO:108    KN-SKVAWLNRSGIIFAGHDKWSLDPRVELEKRHSLEYSLRIQKVDVYDEGSYTCSVQTQ  116
SEQIDNO:109    KS-SKVAWLNRSGIIFAGHDKWSLDPRVELEKRTALEYSLRIQKVDVYDEGSYTCSVQTQ  116
SEQIDNO:110    RS-SKVAWLNRSGIIFAGEDKWSLDPRVELEKRSPLEYSLRIQKVDVYDEGSYTCSVQTQ  116
SEQIDNO:111    RS-SKVAWLNRSGIIFAGEDKWSLDPRVELEKRNPLEYSLRIQKVDVYDEGSYTCSVQTQ  113
SEQIDNO:112    RS-SRVAWLNRSGIIFAGDDKWSLDPRVELEKRSLLEYSLRIQKVDVSDEGPYTCSVQTK  113
SEQIDNO:113    KV-SKVAWLNRSNIIFAGQDKWSLDPRVDLVTKGQLEYSLRIQKVDVYDEGSYTCSIQTK  116
                 :**  .   *: *    *  :**** *  .     ***:*:..  * * * *.:
```

FIGURE 7 cont.

LAMP HOMOLOGY DOMAIN
3

```
SEQIDNO:67   HEPKTSQVYLIVQVPPKISNISS--DVTVNEGSNVTLVCMANGRPEPVITWRHLTP---T  171
SEQIDNO:68   HEPKTSQVYLIVQVPPKISNISS--DVTVNEGSNVTLVCMANGRPEPVITWRHLTP---T  171
SEQIDNO:69   HEPKTSQVYLIVQVPPKISNISS--DVTVNEGSNVTLVCMANGRPEPVITWRHLTP---T  171
SEQIDNO:70   HEPKTSQVYLIVQVPPKISNISS--DVTVNEGSNVTLVCMANGRPEPVITWRHLTP---L  171
SEQIDNO:71   QHTKTMQVYLIVQVPPKISNISA--DITVNEGSNVTLMCIAYGRPEPMITWRHLTP---T  171
SEQIDNO:72   QQSKTSQVYLIVQVPAIIYKVSE--DITVNEGSNVALTCLANGRPDPAITWRLLNP----S  167
SEQIDNO:102  HEPKTSQVYLIVQVPPKISNISS--DVTVNEGSNVTLVCMANGRPEPVITWRHLTP---L  171
SEQIDNO:103  HEPKTSQVYLIVQVPPKISNISS--DVTVNEGSNVTLVCMANGRPEPVITWRHLTP---T  171
SEQIDNO:104  HEPKTSQVYLIVQVPPKISNISS--DVTVNEGSNVTLVCMANGRPEPVITWRHLTP---T  171
SEQIDNO:105  HEPKTSQVYLIVQVPPKISNISS--DVTVNEGSNVTLVCMANGRPEPVITWRHLTP---T  171
SEQIDNO:106  DPR-EITHSVEILVPPKITHVTSGGHLQVRKGSPVRLECSATGNPMPNITWTRKNNLLPN  157
SEQIDNO:107  QHTKTTQVYLIVQVPPKISNISA--DITVNEGSNVTLMCIAYGRPEPMITWRHLTP---T  168
SEQIDNO:108  HEPKTSQVYLIVQVPPKISNISS--DVTVNEGSNVTLVCMANGRPEPVITWRHLTP---T  171
SEQIDNO:109  HQPKTSQVYLIVQVPPKISNISS--DVTVNEGSNVTLVCMANGRPEPVITWRHLTP---T  171
SEQIDNO:110  HHPKTSQVYLIVQVPPKISNISS--DITVNEGSNVTLVCMANGRPEPVITWRHLTP---T  171
SEQIDNO:111  HHPKTSQVYLIVQVPPKISNISS--DITVNEGSNVTLVCMANGRPEPVITWRHLTP---T  168
SEQIDNO:112  QHTKTTQVYLIVQVPPKISNISA--DITVNEGSNVTLMCIAYGRPEPMITWRHLTP---T  168
SEQIDNO:113  QQPKTSQVYLIVQVPASIYQVSN--DITVNEGSNVTLSCLANGRPDPAITWRLLNP----S  171
                  : : **  *  :::    .: *.:** * *  *  *.* * ***    .
```

LAMP HOMOLOGY DOMAIN
4

```
SEQIDNO:67   GREFEGEEEYLEILGITREQSGKYECKAANEVSSADVKQVKVTVNYPPTITESKS        230
SEQIDNO:68   GREFEGEEEYLEILGITREQSGKYECKAANEVSSADVKQVKVTVNYPPTITESKS-NEAT  230
SEQIDNO:69   GREFEGEEEYLEILGITREQSGKYECKAANEVSSADVKQVKVTVNYPPTITESKS-NEAT  230
SEQIDNO:70   GREFEGEEEYLEILGITREQSGKYECKAANEVSSADVKQVKVTVNYPPTITESKS-NEAT  230
SEQIDNO:71   ARDFEGEEEFLEIQGITREQSGRYECKAANEVASADVKQVRVTVNYPPIITESNS-NEAT  230
SEQIDNO:72   AEALDV-GEYLEISGVVRSQAGRYECKASNDVSTPDVKYVNVVVNYPPYIKDVRS-SETA  225
SEQIDNO:102  GREFEGEEEYLEILGITREQSGKYECKAANEVSSADVKQVKVTVNYPPTITESKS-NEAT  230
SEQIDNO:103  GREFEGEEEYLEILGITREQSGKYECKAANEVSSADVKQVKVTVNYPPTITESKS-NEAT  230
SEQIDNO:104  GRELEGEEEYLEILGITREQSGKYECKAANEVSSADVKQVKVTVNYPPTITESKS-NEAT  230
SEQIDNO:105  GREFEGEEEYLEILGITREQSGKYECKAANEVSSADVKQVKVTVNYPPTITESKS-NEAT  230
SEQIDNO:106  GEEQFT-NPVYVIENMDRHKGGTYICTANNGVGQVATSQIILHVLYPPEISVENPTVYSG  216
SEQIDNO:107  ARDFEGEEEFLEIQGITREQSGRYECKAANEVASADVKQVRVTVNYPPIITESKS-NEAT  227
SEQIDNO:108  GREFEGEEEYLEILGITREQSGKYECKAANEVSSADVRQVKVTVNYPPTITESKS-NEAT  230
SEQIDNO:109  GREFEGEEEYLEILGITREQSGKYECKAANEVSSADVKQVKVTVNYPPTITESKS-NEAT  230
SEQIDNO:110  GKEFEGEEEYLEILGITREQSGKYECKAANEVSADVKQVRVTVNYPPTITESKS-NEAA   230
SEQIDNO:111  GKEFEGEEEYLEILGITREQSGKYECKAANEVSADVKQVRVTVNYPPTITESKS-NEAA   227
SEQIDNO:112  ARDFEGEEEFLEIQGITREQSGRYECKAANEVASADVKQVRVTVNYPPIITESKS-NEAT  227
SEQIDNO:113  AEPLDG-EEYLDIIGIMRTQAGRYECKASNDVATPDVKYVNVIVNYPPTIKKTQS-SETP  229
                 . .      *  .: *  :.*  *  *,* * *,   .  :  * *** *.  .   :
```

FIGURE 7 cont.

```
                              LAMP HOMOLOGY DOMAIN
                    5                                               6
SEQIDNO:67    TGRQASLKCEASAVPAPDFEWYRDDTRINSANGLEIKSTEGQSSLTVTNVTEEHYGNYTC  290
SEQIDNO:68    TGRQASLKCEASAVPAPDFEWYRDDTRINSANGLEIKSTEGQSSLTVTNVTEEHYGNYTC  290
SEQIDNO:69    TGRQASLKCEASAVPAPDFEWYRDDTRINSANGLEIKSTEGQSSLTVTNVTEEHYGNYTC  290
SEQIDNO:70    TGRQASLKCEASAVPAPDFEWYRDDTRINSANGLEIKSTEGQSSLTVTNVTEEHYGNYTC  290
SEQIDNO:71    TGKQAILRCEASAVPAPDFEWYKDDTRINSAQGLEIRNTGSRSVLMVANVTEEHYGNYTC  290
SEQIDNO:72    VGQAGVLHCEASAVPQPEFEWYRDERRLSSSQSLTIQVSGSRTVLVVANVTEEDYGNYTC  285
SEQIDNO:102   TGRQASLKCEASAVPAPDFEWYRDDTRINSANGLEIKSTEGQSSLTVTNVTEEHYGNYTC  290
SEQIDNO:103   TGRQASLKCEASAVPAPDFEWYRDDTRITSANGLEIKSTEGQSSLTVANVTEEHYGNYTC  290
SEQIDNO:104   TGRKASLKCEASAVPAPDFEWYRDDTRINSANGLEIKSTEGQSSLTVTNVTEEHYGNYTC  290
SEQIDNO:105   TGRKASLKCEASAVPAPDFEWYRDDTRINSANGLEIKSTEGQSSLTVTNVTEEHYGNYTC  290
SEQIDNO:106   EGQEAMLVCIVHGESQPEVLWHKDTMQIDQTERHVIENRGARHTLIIRKVHPQDFGNYSC  276
SEQIDNO:107   TGKQAILRCEASAVPAPDFEWYKDDTRINSAQGLEIRNTGSRSVLMVANVTEEHYGNYTC  287
SEQIDNO:108   TGRKASLKCEASAVPAPDFEWYRDDTRINSANGLEIKSTEGQSSLTVTNVTEEHYGNYTC  290
SEQIDNO:109   TGRQASLKCEASAVPAPDFEWYRDDTRINSANGLEIKSIEGQSLLMVTNVTEEHYGNYTC  290
SEQIDNO:110   TGRQALLRCEASAVPTPDFEWYRDDTRINSANGLEIKSTGSQSLLMVANVTEEHYGNYTC  290
SEQIDNO:111   TGRQALLRCEASAVPTPDFEWYRDDTRINSANGLEIKSTGSQSLLMVANVTEEHYGNYTC  287
SEQIDNO:112   TGKQAILRCEASAVPAPDFEWYKDDTRINSAQGLEIRNTGSRSVLMVANVTEEHYGNYTC  287
SEQIDNO:113   VGRNGTLRCEVTAVPTPEFEWYRDDKRLANTQSITIQTSGTTTSLTIANITEEDYGNYTC  289
              *:  . * *  . .    *:. *::*   ::  .::    *.        *  :  ::   :.:***:*

Trns Memb.

SEQIDNO:67    VAANKLGVTNASLVLFRPGSVRGINGSISLAVPLWLLAASLLCLL-SKC-----------  338
SEQIDNO:68    VAANKLGVTNASLVLFRPGSVRGINGSISLAVPLWLLAASLLCLL-SKC-----------  338
SEQIDNO:69    VAANKLGVTNASLVLFRPGSVRGINGSISLAVPLWLLAASLLCLL-SKC-----------  338
SEQIDNO:70    VAANKLGVTNASLVLFSKYAKTEPDSMQVIE-FLHIDLKSIRHPL-KVNPIQK-------  341
SEQIDNO:71    VAANKLGITNTSLYLYI-GPGTPIDNATSLAASLWLMANILLCLF-CTC-----------  337
SEQIDNO:72    VATNRLGVHNASVFLYKPGMGRDINSAGCICQSLWLLLCVSSAL-LQC------------  333
SEQIDNO:102   VAANKLGVTNASLVLFRPGSVRGINGSISLAVPLWLLAASLFCLL-SKC-----------  338
SEQIDNO:103   VAANNLGVTNASLVLFRPGSVRGINGSISLAVPLWLLAASLLCLL-SKC-----------  338
SEQIDNO:104   VAANNLGVTNASLVLFRPGSVRGINGSISLAVPLWLLAASLLCLL-SKC-----------  338
SEQIDNO:105   VAANNLGMTNASLVLFRPGSVRGINGSISLAVPLWLLAASLLCLL-SKC-----------  338
SEQIDNO:106   IADNQLGKTRKTVTLTGKPKTAVF---RSVPNSQWKDKYNISWIVDSHSPIEEFKLYYRQ  333
SEQIDNO:107   VAANKLGITNTSLYLYI-GPGTPIDSATSLAASLWLMANLLFCLF-CTC-----------  334
SEQIDNO:108   VAANNLGVTNASLVLFRPGSVRGINGSISLAVPLWLLAASLLCLL-SKC-----------  338
SEQIDNO:109   VAANKLGVTNASLILFRPGSVRGINGSISLAVPLWLLAASLFCLL-SKC-----------  338
SEQIDNO:110   VAANKLGVTNASLYLYRPGTGRVDNGSVSLAVPLWLLAASLLCLL-SKC-----------  338
SEQIDNO:111   VAANKLGVTNASLYLYRPGTGRVDNGSMSLAVPLWLLAASLLCLL-SKC-----------  335
SEQIDNO:112   VAANKLGITNTSLYLYI-GPGTPIDSATSLAASLWLMANLLFCLF-CTC-----------  334
SEQIDNO:113   VASNRLGVQNASLFLYRPGTGRDINGSACVSQSLWLLLASFACLF-LKC-----------  337
              :* *.**   . :: *                   :           .   .
```

FIGURE 7 cont.

```
SEQIDNO:67    ------------------------------------------------------------- 338
SEQIDNO:68    ------------------------------------------------------------- 338
SEQIDNO:69    ------------------------------------------------------------- 338
SEQIDNO:70    ------------------------------------------------------------- 341
SEQIDNO:71    ------------------------------------------------------------- 337
SEQIDNO:72    ------------------------------------------------------------- 333
SEQIDNO:102   ------------------------------------------------------------- 338
SEQIDNO:103   ------------------------------------------------------------- 338
SEQIDNO:104   ------------------------------------------------------------- 338
SEQIDNO:105   ------------------------------------------------------------- 338
SEQIDNO:106   MTFSIGQLQPLQTDWRDIVLPAFPYSHHYTQGMSYLIRGLEPDQQYEARVQSRNRYGWSD 393
SEQIDNO:107   ------------------------------------------------------------- 334
SEQIDNO:108   ------------------------------------------------------------- 338
SEQIDNO:109   ------------------------------------------------------------- 338
SEQIDNO:110   ------------------------------------------------------------- 338
SEQIDNO:111   ------------------------------------------------------------- 335
SEQIDNO:112   ------------------------------------------------------------- 334
SEQIDNO:113   ------------------------------------------------------------- 337

SEQIDNO:67    ---------------------------- 338
SEQIDNO:68    ---------------------------- 338
SEQIDNO:69    ---------------------------- 338
SEQIDNO:70    ---------------------------- 341
SEQIDNO:71    ---------------------------- 337
SEQIDNO:72    ---------------------------- 333
SEQIDNO:102   ---------------------------- 338
SEQIDNO:103   ---------------------------- 338
SEQIDNO:104   ---------------------------- 338
SEQIDNO:105   ---------------------------- 338
SEQIDNO:106   FSESFLFTTSNTGKWMGQCCTNPG     417
SEQIDNO:107   ---------------------------- 334
SEQIDNO:108   ---------------------------- 338
SEQIDNO:109   ---------------------------- 338
SEQIDNO:110   ---------------------------- 338
SEQIDNO:111   ---------------------------- 335
SEQIDNO:112   ---------------------------- 334
SEQIDNO:113   ---------------------------- 337
```

| LIMBIC/LSAMP | | | | | |
|---|---|---|---|---|---|
| Accession No. | Species | SEQ ID NO: | Accession No. | Species | SEQ ID NO: |
| NP_002329.2 | H. sapiens | 67 | NP_001192297.1 | B. Taurus | 105 |
| XP_516662.2 | P. trogiodytes | 68 | XP_312298.5 | A. gambiae | 106 |
| XP_002716722.1 | O. cuniculus | 69 | NP_001096385.1 | X. tropicalis | 107 |
| NP_780757.1 | M. musculus | 70 | XP_003434117.1 | C. lupus familiaris | 108 |
| NP_001086181.1 | X. laevis | 71 | XP_001362972.1 | M. domestica | 109 |
| NP_001034921.1 | D. rerio | 72 | NP_990205.1 | G. gallus | 110 |
| NP_058938.1 | R. norvegicus | 102 | XP_002190582.1 | T. guttate | 111 |
| XP_001502710.1 | E. caballus | 103 | NP_001096385.1 | X. tropicalis | 112 |
| NP_001231626.1 | S. scrofa | 104 | XP_003449349.1 | O. niloticus | 113 |

FIGURE 8: HUMAN ENDOLYN ALIGNMENT WITH ORTHOLOGOUS SEQUENCES

```
                SIGNAL SEQUENCE              LAMP HOMOLOGY DOMAIN

SEQIDNO:5    MSRLSRSLLWAATCLGVLCVLSADKNTTQH-PNVTTLAPISNVTSAP-----V-TSLPLV 53
SEQIDNO:73   MSGSSRRLLWAATCLAVLCVSAAQPNITTLAPNVTEVPT-----TT-----TKVVPTTQM 50
SEQIDNO:74   MSRLSRSLLWAVTCLAVLCVLSAEENPTPH-TNVTSLAPTSNITSAP-----V-TSLPLV 53
SEQIDNO:75   MLGLSRQLLWAVGCLAALCVLTAAKNSTIL-PPSTTTPWLSPPTTQT-------TSAPPKTL 54
SEQIDNO:76   MSGLSRPLLLAVGCLAALCVITAAGNTTLA-PNVTTASS-PPPTTTTVPVSPTTLSPLPV 58
SEQIDNO:77   MSGLSRPLLLAVGYLAALCVITAARNTTVT-PNVTTPSS-PPPTTATVPVSPTTLTPPPV 58
SEQIDNO:78   MSGLSRQLCWAAACLAALCALTAAQSFSSD-PNGTTTTTQATTDAAT----TRVTTAAPA 55
SEQIDNO:79   MSGASRGLFWAATCLAALCLSAAQSNS-SASPNVTDPPT-----TT-----SKVVPTTLT 49
                  *   ** *  *.  *..**   :*    .            *            :

LAMP HOMOLOGY DOMAIN
                  1    2  3       4    5       6         7        8
SEQIDNO:5    TTPAPETCEGRNSCVSCFNVSVV-NTTCFWIECKD--ESYCSHNSTVSDCQVGNTTDFCS 110
SEQIDNO:73   PTVLPETCASFNSCVSCVNATFTNNITCFWLHCQEANKTYCAN-EPLSNCSQVNRTDLCS 109
SEQIDNO:74   TTPAPETCEGRNSCVSCFNASTV-NTTCFWIECKD--ESYCSHNSTVSDCQVGNTTDFCS 110
SEQIDNO:75   PTPAPEICENRNSCISCFDA-----NNTCFWIECKG--KSYCSDNSTVSDCHVVNGTDFCS 108
SEQIDNO:76   TTPAPDICGSRNSCVSCVDG----NATCFWIECKG--KSYCSDNSTAGDCKVVNTTGFCS 112
SEQIDNO:77   TTPAPDICGSRNSCISCVDG----NATCFWIECKG--KSYCSDNSTVSDCKVVNTTGFCA 112
SEQIDNO:78   TTPAPDPCDNRNSCVSCVNTSVD-ATACSWIECKE--KSYCSHNTTVSDCQVVNSTQLCS 112
SEQIDNO:79   TTKPPETCESFNSCVSCVNATLTNNITCVWLDCHEANKTYCSS-ELVSNCTQKTSTDSCS 108
                *  *: *  . ***:**.:        :* *:..*:    ::**:    .:*   . * *:

LAMP HOMOLOGY DOMAIN
SEQIDNO:5    VST-ATPVPTANSTAKPTVQPSPSTT--SKIVTTSGTTNNTVTPTSQPVRKSTFDAASFIG 168
SEQIDNO:73   VIPPTTPVPT-NSTAKPTTRPSSPTPTPSVVTSAGTTNTTLTPTSQPERKSTFDAASFIG 168
SEQIDNO:74   VPT-ATLVPTANSTAKPTVQPSPSTT--SKTVTTSGTTNTTVTPTSQPVRKSTFDAASFIG 168
SEQIDNO:75   GPT-VTPLPT-NSTAKTTTLPSPSSA--STTATTSGTTNTTLAPTTQPMRKSTFDAASFIG 165
SEQIDNO:76   VPT-TTPTPT-NSTAKTTTLPSTTTT--STTATTSGTTNTTLSPTIQPTRKSTFDAASFIG 169
SEQIDNO:77   VPT-TTPTPT-NSTAKTTTLPSTTTT--STTATTSGTANTTLTPTIQPMRKSTFDAASFIG 169
SEQIDNO:78   APE-PTMMPT-NSTAKTTTQPSSSTA--TTTATTSGTTNITLSPTSQPGRKSTFDAASFIG 169
SEQIDNO:79   VIP-TTPVPT-NSTAKPTTRPSSPTPTPSVVTSAGATNTTVTPTSQPERKSTFDAASFIG 166
                *   ** *****  *. **    :   ...*::*::*  *::**  ** ************

Trns Memb.  Cytoplasmic Tail

SEQIDNO:5    GIVLVLGVQAVIFFLYKFCKSKERNYHTL 197
SEQIDNO:73   GIVLVLGVQAVIFFLYKFCKSKERNYHTL 197
SEQIDNO:74   GIVLVLGVQAVIFFLYKFCKSKERNYHTL 197
SEQIDNO:75   GIVLVLGVQAVIFFLYKFCKSKERNYHTL 194
SEQIDNO:76   GIVLVLGVQAVIFFLYKFCKSKERNYHTL 198
SEQIDNO:77   GIVLVLGVQAVIFFLYKFCKSKERNYHTL 198
SEQIDNO:78   GIVLILGVQAVIFFLYKFCKSKERNYHTL 198
SEQIDNO:79   GIVLVLGVQAVIFFLYKFCKSKERNYHTL 195
             ****:************************
```

FIGURE 8 cont.

| | Endolyn | | | | |
|---|---|---|---|---|---|
| Accession No. | Species | SEQ ID NO: | Accession No. | Species | SEQ ID NO: |
| NP_006007.2 | H. sapiens | 5 | NP_001039506.1 | B. taurus | 76 |
| NP_058594.1 | M. musculus | 73 | XP_004011265.1 | O. aries | 77 |
| XP_001091286.1 | M. mulatta | 74 | XP_532256.2 | C. lupus familiaris | 78 |
| XP_001924661.2 | S. scrofa | 75 | NP_114000.1 | R. norvegicus | 79 |

FIGURE 9: HUMAN MACROSAILIN ALIGNMENT WITH ORTHOLOGOUS SEQUENCES

```
               SIGNAL SEQUENCE            LAMP HOMOLOGY DOMAIN 1
                                  1
SEQIDNO:80   MRLAVLFSGALLGL-LAAQGTGNDCPHKKSATLLPSFTVTPTVTEST----GTTSHRTTK 55
SEQIDNO:81   MRLAVLFSGALLGL-LAAQGTGNDCPHKKSATLLPSFTVTPTVTEST----GTTSHRTTK 55
SEQIDNO:82   MRLAVFFSGALLGL-LAAQGTGNDCPHKKSATLLPSFTVTPTATESTPS-PGTTSHRTTK 58
SEQIDNO:83   MRLPVCL---ILLGP-LIAQGTEEDCPHKKAVTLLPSFTMTPTATESTAS-PTTSHRPTTT 56
SEQIDNO:84   MRLAVLFLGALLGL-LAAQGTGNDCPHKKSATLLPSFTVTPTATEST----GTTSHRTTK 55
SEQIDNO:85   MRFPVCL--TLLVL-LVAQGTGKDCPHKKAATLLPSFTETPTTTGSTAS-PTTTHRPTTT 56
SEQIDNO:86   MRPAVFFLGALVGL-LAAQGTRSDCPHKKSATLLPSFTVTPTATESTGS-PGTTSHSTTT 58
SEQIDNO:87   MRLAVLFSGALLGL-LAAQETGNDCPHKKSATLLPSFTVTPTATESTAS-PGTTSHQTTQ 58
SEQIDNO:88   MRLPVLFLA-LLGL-HAA-----------------------------S-SGTTSHRTTK 27
SEQIDNO:89   MTLAVLFLGALLGL-LAESTTSH-------------------------------------- 22
SEQIDNO:90   MRLAVLFSGALLGL-LAAQGTGNDCPHKKSATLLPSFTVTPTATEST----GTTSHRTTK 55
SEQIDNO:91   MRLSLLLSGILLGL-LAEQGAGDKCPQEKSVTLVPSFTVTTIATERSTTSPETTTSSGS- 58
SEQIDNO:92   -------MGLTLPLPAQGSQCRANCPHKKSATLVPSFTVTPTATSG----PTTTAHQTTT 49
                                :

LAMP HOMOLOGY DOMAIN 1

SEQIDNO:80   SHKTTTHRTTT--------TGTTSHGPTTATHNPTTTSHGNVTVHPTSNSTATSQGPSTAT 108
SEQIDNO:81   SHKTTTHRTTT--------TGTASHGPTTATHNPTTTSHGNVTVHPTSNSTATSQGPSTAT 108
SEQIDNO:82   SHRTTTWRISTTTHTTNTTGTTSSESPTATHSPA-------------------------- 92
SEQIDNO:83   SHGNVTVH--------T-----SSGPTTVTHNPA-------------------------- 77
SEQIDNO:84   SHKTTTHRTTT--------TGTTSHRPTTATHNPTTTSHRNATVHPTSNSTATSQGPSTAT 108
SEQIDNO:85   SHRPTTTS--------HRPTTTSHRPTTTSHRPT-------------------TTS 85
SEQIDNO:86   AETT-------------------SHAPNTTTHQ-------------------------- 72
SEQIDNO:87   SHRTTTT-----------GTTSDHPTTATHNP-------------------------- 79
SEQIDNO:88   NPHTT--------SHSTATPGTTSHRPTTAT-------------------------- 50
SEQIDNO:89   --RTTTPR-------TTTTGTTSHGPTTVTHNPA-------------------------- 47
SEQIDNO:90   SHKTTTHRTTT--------TGTTSHRPTTATHNPNTTSHRNATVHPTSNSTATSQGPSTAT 108
SEQIDNO:91   --TATTYRTS-------TAATTPHS--------------------NSTATS------- 80
SEQIDNO:92   DHGTTTSHETTTSQGTSTHGTSTPHTTTTGHGTT--TGHQN------TSH------------ 91

LAMP HOMOLOGY DOMAIN 1

SEQIDNO:80   HSPATTSHGNATVHPT-SNSTATSPG----------F-T--SSAHPEPPPPSPSPSPTSK 154
SEQIDNO:81   HSPATTSHGNATVHPT-SNSTATSPG----------F-T--SSAHPEPPPPSPSPSPTSK 154
SEQIDNO:82   ----TTTSHQNTTVHPT-SNITATSPG----------PST--RSPHPEP--PPSPSPSPGSK 135
SEQIDNO:83   ---TTTSHGNATISHATVSPTT-----NG-TATSPRSST--VGPHPGPPPPSP--SPRSK 124
SEQIDNO:84   HRPATTSHGNATVHPT-SNSTATSPG----------L-T--SSAHPGPPPPSPSPSPASK 154
SEQIDNO:85   HRPTTTSHGNATV-----SP---------TTNSPGFST--VGPHPGPPPPSPSPSPSST 128
SEQIDNO:86   -APTTPGHRNTTIHPTTSNSTSNTTGTTGTGKPHTSTSY--TQPGPGPRPPPPSPGPGPQ 129
SEQIDNO:87   ---TTTSHGNTTVHPTTSNSTVTSPG-----------SAS--SSPHPRPPPSPSPSPGSK 124
SEQIDNO:88   ---PTTGHGNVTVHPTTSNTTSNTTTTTTGTS---PGFST--STPHPGPPPPPSPSPSGSR 102
SEQIDNO:89   ----TTTSHGNATVHPT-SSSTATSPG----------SST--RPPHPGPPPPSPSPSPGSQ 91
SEQIDNO:90   HRPATTSHGNATVHPT-SNSTATSPG----------L-T--SSAHPGPPPPSPSPSPASK 154
SEQIDNO:91   --YSTTSEGTAVTHGTTTSPRN-------------TSTT--STSQSVPVPPSPQPTSSPS 123
SEQIDNO:92   --STTTSHGTSTPHKTTTRHPTTSHGTTTSHGTSTGHWTARPTIRPGPPPPPP----SPG 145
                  * ..  .                              * ** *
```

FIGURE 9 cont.

LAMP HOMOLOGY DOMAIN

```
                   2
SEQIDNO:80  ETIGDYTWTNGSQPCVHLQAQIQIRVMYTTQGGG----------EAWGISVLNPNK-TKVQ 204
SEQIDNO:81  ETIGDYTWTNGSQPCVHLQAQIQIRVMYTTQGGG----------EAWGISVLNPNK-TKVQ 204
SEQIDNO:82  EAIGDYTWSNGSQPCVRLQAQIQIRVLYPTQGGG----------EAWGISVLNPNR-TKAQ 185
SEQIDNO:83  GALGNYTWANGSQPCVQLQAQIQIRILYPIQGGRKVKLKWGLKRAWGISVLNPNK-TKVQ 183
SEQIDNO:84  ETIGDYMWTNGSQPCVHLQAQIQIRVMYTTQGGG----------EAWGISVLNPNK-TKVQ 204
SEQIDNO:85  GALGNYTWTNGSQPCVQLQAQIQIRILYLTQGGK----------KAWGLSVLNPNK-TKVQ 178
SEQIDNO:86  DAIGDYTWTTGSQPCARLQARIQIGVVYPTQAGG----------QAWGISVLNPNS-TKPW 179
SEQIDNO:87  EAIGDYIWTNGSQPCVRLQAQIQIRVLYPTLGGG----------KAWGISVLNPNK-TKAQ 174
SEQIDNO:88  EAVGNYTWTNGSQPCVQLQAQIQIRVLYPTQGGG----------QAWGMSVLNPNR-TKAQ 152
SEQIDNO:89  EAIGDYTWTNGSQPCVQLQAQIQIRVLYPTQGGG----------EAWGISVLNPNK-TKAL 141
SEQIDNO:90  ETIGDYMWTNGSQPCVHLQAQIQIRVMYTTQGGG----------EAWGISVLNPNK-TKVQ 204
SEQIDNO:91  GAVGDYIGANGSQLCVHLRAQIQMRVLYQASGGG----------KLWGIFVLNPNR-TMAQ 173
SEQIDNO:92  KAVGNYTVFNGSQPCLRLRAEIRLWVLYQAQEEGEAPPVSG-------AASFPPPRPRPVA 199
            ::*:*   .*** * :*:*.*:: ::*                      : *
```

LAMP HOMOLOGY DOMAIN

```
                   3
SEQIDNO:80  GSCEGAHPHLLLSF----PYGHLSFGFMQDLQQ--KVVYLSYMAVEYNVSFPHAAQWTFS 258
SEQIDNO:81  GSCEGAHPHLLLSF----PYGHLSFGFMQDLQQ--KAVYLSYMAVEYNVSFPHAAQWTFS 258
SEQIDNO:82  GGCEGTHSHLLLSF-----PSGQLSFGFKQDPLQ--SAVYLNYMAVEYNVSFPQAVQWTFS 239
SEQIDNO:83  GGCDGTHPHLSLSF----PYGQLTFGFKQDLHQSPSTVYLDYMAVEYNVSFPQAAQWTFM 239
SEQIDNO:84  GSCEGAHPHLLLSF-----PYGHLSFGFMQDLQQ--RVVYLSYMAVEYNVSFPHAAQWTFS 258
SEQIDNO:85  GGCDSAHPHLALSF----PYGQLTFGFKQDRHQSHSTVYLNYMAVEYNVSFPQAAQWTFS 234
SEQIDNO:86  GDCDGARPHLLLSF-----PFGQLSFGFTQEPQQ--GSVYLDYLALQYNVSFPQAAQWTFS 233
SEQIDNO:87  GGCA--HPHLLLSF----PYGQLSFGFKQEPLQ--STVYLNYIAVEYNVSFPQAAQWTFL 226
SEQIDNO:88  GGCEGPRPHLLLSF-----PYGQLSFGFKQDPGQGQSAVYLSYLAVEYNVSFPQAARWTFS 208
SEQIDNO:89  GGCEGAHPHVRLSF----PYGQLTFGFKQQPQE--STVYLNYMAVEYNVSFPRAAQWTFS 195
SEQIDNO:90  GSCEGAHPHLLLSF----PYGHLSFGFMQDLQQ--RVVYLSYMAVEYNVSFPHAAQWTFS 258
SEQIDNO:91  GNCEANHSSLILSF-----PNGKLIFGFKQDSIK---KIVYLSHLATEFNVSFPSATRWIFS 227
SEQIDNO:92  GEGDGERSRVTPVASAMTVEGGSRAGFAM-------------------------------- 228
            *    :   :      *   **
```

LAMP HOMOLOGY DOMAIN

```
                   4                                              5
SEQIDNO:80  AQNASLRDLQAPLGQSFSCSNSSIILSPAVHLDLLSLRLQAAQLPHTGVFGQSFSCPSDR 318
SEQIDNO:81  AQNASLRDLQAPLGRSFSCSNSSIILSPAVHLDLLSLRLQAAQLPHTGVFGQSFSCPSDR 318
SEQIDNO:82  VQNSSLRDLQTPLGHSFSCRNASIIVSPALHLDLLSLKLQAAQLSPSGAFGPSFSCPNDK 299
SEQIDNO:83  AQNSSLRELQAPLGQSFCCGNASIVLSPAVHLDLLSLRLQAAQLPDKGHFGPCFSCNRDQ 299
SEQIDNO:84  AQNASLRDLQAPLGQSFSCSNSSIILSPAVHLDLLSLRLQAAQLPHTGVFGQSFSCPSDR 318
SEQIDNO:85  AQNSSLQELQAPLGQSFCCGNTSIVLSPAIHLDLLSLRLQAAQLPDKGHFGPCFSCASDQ 294
SEQIDNO:86  GQNASLRALQAPLGQSFSCRNASILLTPALRLDLLHLKLQAAQLPPSGAFGPSFSCPSEH 293
SEQIDNO:87  VQNSSLRDLQAPLGQRFSCRNASIALSPAFHLDLLSLKLQAAQLTPTGAFGPSFSCPSDQ 286
SEQIDNO:88  AQNASLRDLQAPLGQSFSCRNASIAVSPALHLDLLSLRVQAAQLPRTGIFGPSFSCPADH 268
SEQIDNO:89  VQNSSLRDLQTPVGRSYSCRNASIILSTAFHLDLLSLKLQAAQLPPTGNFGPSFSCPSDQ 255
SEQIDNO:90  AQNASLRDLQAPLGQSFSCSNSSIILSPAVHLDLLSLRLQAAQLPHTGVFGQSFSCPSDR 318
SEQIDNO:91  VENSSLQDLQTPLGHSFSCRNPSIALSPDIHLDLLSLQLQAAQLSSSGAFGAAFSCSADL 287
SEQIDNO:92  -LGAEVRSRAPSLGRAGKTRL--RIHQPVVVLQ-------HTYYV--------------- 263
            .:.::    :*:           .  *:         :
```

FIGURE 9 cont.

```
                         Trans. Domain     Cyto Tail
SEQIDNO:80        -SILLPLIIGLILLGLLALVLIAFCIIRRRPSAYQAL 354
SEQIDNO:81        -SILLPLIIGLILLGLLALVLIAFCIIRRRPSAYQAL 354
SEQIDNO:82        -SILLPLIIGLILLGLLTLVLVTFCIIRRRPPTYQPL 335
SEQIDNO:83        -SLLLPLIIGLVLLGLLTLVLIAFCITRRRQSTYQPL 335
SEQIDNO:84        -SILLPLIIGLVLLGLLALVLIAFCIVRRRPSAYQAL 354
SEQIDNO:85        -SLLLPLIIGLVLLGLLTLVLIAFCVTRRRQSTYQPL 330
SEQIDNO:86        -FNLLPLIVGVISLGLLALALVTFCIIRRRPPTYQPL 329
SEQIDNO:87        -SILLPLIIGLILLGLFALVLITFCVIRRRPPTYQAL 322
SEQIDNO:88        PSILVPLIIGLILVGLLALVLVAFCIARRRPSAYQAL 305
SEQIDNO:89        -TILLPLIIGLIFLGLLILVLVTFCIIRRRPPAYQPL 291
SEQIDNO:90        -SILLPLIIGLVLLGLLALVLIAFCIVRRRPSAYQAL 354
SEQIDNO:91        -NILVPLVVGLVLLTLLILVLSAFCISRRRPPAYQPL 323
SEQIDNO:92        ------------------------------------ 263
```

|  | Macrosailin |  |  |  |  |
|---|---|---|---|---|---|
| Accession No. | *Species* | SEQ ID NO: | Accession No. | *Species* | SEQ ID NO: |
| NP_001242.2 | *H. sapiens* | 80 | XP_849733.1 | *C. lupus familiaris* | 86 |
| XP_003315403.1 | *P. troglodytes* | 81 | NP_001093232.1 | *E. caballus* | 87 |
| NP_001039367.1 | *B. taurus* | 82 | XP_002719034.1 | *O. aries* | 88 |
| BAA23738.1 | *M. musculus* | 83 | XP_003131995.1 | *S. scrofa* | 89 |
| XP_014974003.1 | *M. mulatta* | 84 | XP_003912313.1 | *P. anubis* | 90 |
| NP_001026808.1 | *R. norvegicus* | 85 | XP_001369761.1 | *M. domestica* | 91 |
|  |  |  | XP_001517723.2 | *O. anatinus* | 92 |

FIGURE 10: HUMAN LAMP5 ALIGNMENT WITH ORTHOLOGOUS SEQUENCES

SIGNAL SEQUENCE      LAMP HOMOLOGY DOMAIN

```
                                                          1
SEQIDNO:93   MDLQGRGVPSIDRLRVLLMLFHTMAQIMAEQEVENLSGLSTNPEKDIFVVRENGTTCLMA 60
SEQIDNO:94   MDLRGRAVPSIDRLRVLLMLFHTMAQIMAEQEVENLSGLSTNPEKDIFVVRENGTTCLMA 60
SEQIDNO:95   MDLQGRAVPSVDRLRVLLMLFHTMAQIMAEQEVENLSGLSTNPEKDIFVVRENGTTCLMA 60
SEQIDNO:96   MDLRGRAFPSVYRLRVLLMLFYTMARITAEQEVENLSGLSTNPEKDIFVVRENGTTCLMA 60
SEQIDNO:97   MDLRRRALLGVDGLRVLLMLFHTVTRIMAEQEVENLSGLSTNPEKDIFVVRENGTTCLMA 60
SEQIDNO:98   MDLRVRTLLGGDRLRILLMFFHVMVQTVAEQEVENLSGLSTNPEKDIFVVRENGTTCLMA 60
SEQIDNO:99   MDLRGRALLGGDRLRILLMFFHAMAQTVAEQEVENLSGLSTNPEKDIFVVRENGTTCLMA 60
SEQIDNO:100  ----------MAAGRLPGLLFLLHAAARLAAEQEVENLSGLSPNPEKDIFVVRENRTTCLMA 52
SEQIDNO:101  ---MDYRACTSALRMPVLLLLLCTFSCNLAEQEVENLSGLSSNPDKNIFAIRENGTTCLMA 58
                       :  **:::  .      ********** **:*:**.:*** ******
```

LAMP HOMOLOGY DOMAIN

```
                                    2
SEQIDNO:93   EFAAKFIVPYDVWASNYVDLITEQADIALTRGAEVKGRCGHSQSELQVFWVDRAYALKML 120
SEQIDNO:94   EFAAKFIVPYDVWASNYVDLITEQADIALTRGAEVKGRCGHSESELQVFWVDRAYALKML 120
SEQIDNO:95   EFAAKFIVPYDVWASNYVDLITEQADIALTRGAEVKGRCGHSESELQVFWVDRAYALKML 120
SEQIDNO:96   EFAAKFIVPYDVWASNYVDLITEQADISLTRGAEVKGHCGHNESELQVFWVDRAYALKML 120
SEQIDNO:97   EFAAKFIVPYDVWASNYVDLITEQADISLTRGAEVKGHCGHDESELQVFWVDRAYALKML 120
SEQIDNO:98   EFAAKFIVPYDVWASNYVDLITEQAEISLTRGAEVKGHCGHNESELEVFWVDHAYTLRML 120
SEQIDNO:99   EFAAKFIVPYDVWASNYVDLITEQAEISLTRGAEVKGRCGHNESELQVFWVDRAYTLKML 120
SEQIDNO:100  EFAAKFVVPYDVWASNYVDLITEQADIPLSRGAEMKGKCGTNESELEISWLERAYTLKLF 112
SEQIDNO:101  EFSARILVPYEVPSSNEVDWDLEEASIQLPRDTEIRGKCWNNESELHLSWLDKAYTLKLF 118
             **:*:::.***:* :** **    *:*.* * *.:*::*:*  .:***.: *:::**:*:::
```

LAMP HOMOLOGY DOMAIN

```
SEQIDNO:93   FVK---------------------------ESHNMSKGPEATWRLSKVQFVYDSSEKTHF 153
SEQIDNO:94   FVK---------------------------ESHNMSKGPEATWRLSKVQFVYDSSEKTHF 153
SEQIDNO:95   FVK---------------------------ESHNTSKGPEATWRLSKVQFVYDSSEKTHF 153
SEQIDNO:96   FVK---------------------------ESRNASKGPEATWRLSKVQFVYDSSEKTHF 153
SEQIDNO:97   FLK---------------------------ESHNTPKGPEATWKLSKVQFVYDSSEKTHF 153
SEQIDNO:98   FVK---------------------------ESHNTSKGPEATWNLNKVHFVYDSSEKTHF 153
SEQIDNO:99   FVK---------------------------ESHNTSKGLEATWKLSKVQFVYDSSEKTHF 153
SEQIDNO:100  FLKVRGCPRRLGRGRCAAALRGPDQPCPPQEGHNTSRGPEAFWRLSRIQFSYDTSERTYF 172
SEQIDNO:101  FSK---------------------------EGQDA--SKSRSWKMSKIQFLYDPSEHTIF 149
             * *                            *.::    . . *.:.::::* ** **:* *
```

FIGURE 10 cont.

```
                              LAMP HOMOLOGY DOMAIN
                                       3
SEQIDNO:93   KDAVSAGKHTANSHHLSALVTPAGKSYECQAQQTISLASSDPQKTVTMILSAVHIQPFDI 213
SEQIDNO:94   KDAVSAGKHTANSHHLSALVTPAGKSYECQAQQTISLASSDLQKTVTMILSAVHIQPFDI 213
SEQIDNO:95   KDAVSAGKHTANSHHLSALVTPAGKSYECQAQQTISLASSDPQKMVTMILSAVHIQPFDI 213
SEQIDNO:96   KDAVSAGKHTANSHRLSALVTPAGKSYECQAQQSISLASSDPQKTVTMILSAVHIQPFDI 213
SEQIDNO:97   KDAVSAGKHTANSHHLSALVTPAGKSYECQAQQTISLASSDPQKTVTMILSAVHIQPFDI 213
SEQIDNO:98   KAPVKVNKYIASSHHLSALVTPAGMSYECQAQQTISLASSDPQKTVTMILSAVHIQPFDI 213
SEQIDNO:99   KDAVSAGKHTANSHHLSALVTPAGMSYECQAQQTISLASSDPQKTVTMILSAVHIQPFDI 213
SEQIDNO:100  KDAVSPGKHTASSHRLSALVTPAGKSYECQAQQTISLISSDHQKSVQLLLSEVRIQPFDI 232
SEQIDNO:101  KSGARPGRHTANSHHLSLMVTPAGMSYECEATQRISLTSTDHQKIVVLYLSEVHLQPFDI 209
              *    . .::  *.**:**  :***** ****:* * ***  *;* **  * : ** *::*****

Trans. Domain        Cyto Tail
                                  4
SEQIDNO:93   ISDFVFSEEHKCPVDEREQLEETLPLILGLILGLVIMVTLAIYHVHHKMTANQVQIPRDR 273
SEQIDNO:94   ISDFVFSEEHKCPVDEREQLEETLPLILGLILGLVIMVTLAIYHVHHKMTANQVQIPRDR 273
SEQIDNO:95   ISDFVFSEEHKCPVDEREQLEETLPLILGLILGLVIVVTLTIYHVHHKMTANQVQIPRDR 273
SEQIDNO:96   ISDFVFSEEHKCPVDEREQLEETLPLILGLILGLVIVVTLAIYHIHHKMTANQVQIPRDR 273
SEQIDNO:97   ISDFVFSEEHKCPVDEREQLEETLPLILGLILGLVIVVTLVIYHIHHKMTANQVQIPRDR 273
SEQIDNO:98   ISDFVFSEEHKCPVDEQEQLEETLPLILGLILGLVIVITLVIYHIHHKMTANQVQIPRDR 273
SEQIDNO:99   ISDFVFSEEHKCPVDEREQLEETLPLILGLILGLVIVITLVIYHIHHKMTANQVQIPRDR 273
SEQIDNO:100  TADFVFSEEHKCPVDQREQLEETLPLILGLILGLVIVITLCVYHIHHKLTANQVQIPRDR 292
SEQIDNO:101  KSDFVYSEEYKCPTDQRKQLEETLPLILGLTLGVAILIIVAVYHIHHKMTANQVQIPRDR 269
              :***:***:***.*::;************ **:.*:: : :**:*** .***********

SEQIDNO:93   SQYKHMG  280
SEQIDNO:94   SQYKHMG  280
SEQIDNO:95   SQYKHMG  280
SEQIDNO:96   SQYKHMG  280
SEQIDNO:97   SQYKHMG  280
SEQIDNO:98   SQYKHMG  280
SEQIDNO:99   SQYKHMG  280
SEQIDNO:100  SQYKHMG  299
SEQIDNO:101  SLYKHMG  276
              * *****
```

| LAMP5 | | | | | |
|---|---|---|---|---|---|
| Accession No. | Species | SEQ ID NO: | Accession No. | Species | SEQ ID NO: |
| NP_036393.1 | H. sapiens | 93 | NP_001076887.1 | B. taurus | 97 |
| XP_514512.3 | P. troglodytes | 94 | NP_083806.2 | M. musculus | 98 |
| NP_001181627.1 | M. mulatta | 95 | NP_001014205.1 | R. norvegicus | 99 |
| XP_850634.1 | C. lupus familiaris | 96 | XP_004935300.1 | G. gallus | 100 |
| | | | NP_001090781.1 | X. tropicalis | 101 |

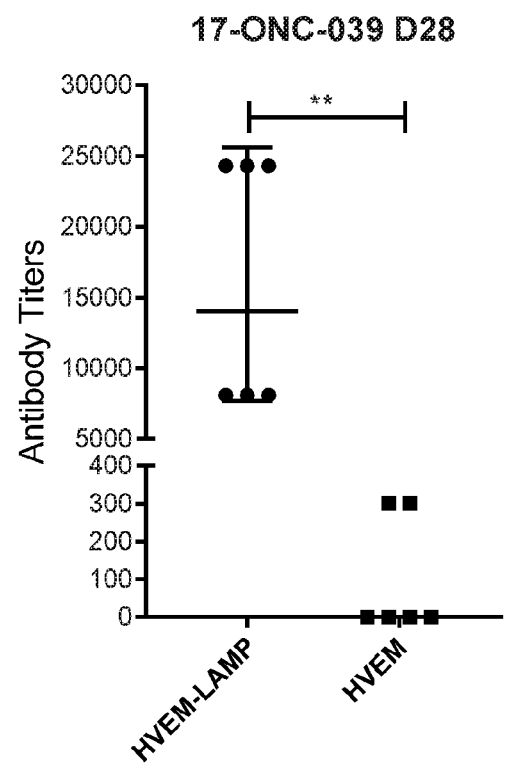
Figure 11    HVEM specific IgG antibody (day 28)

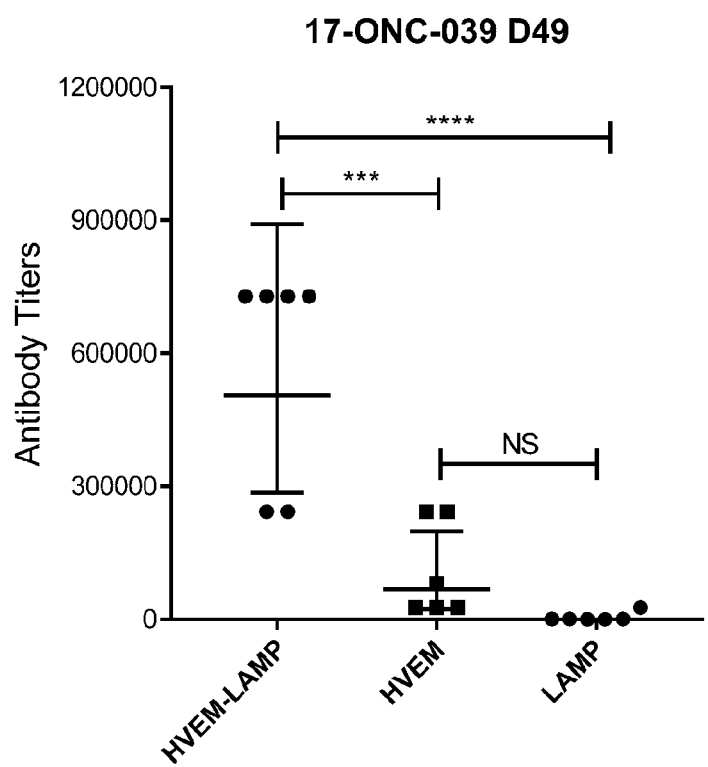
Figure 12  HVEM specific IgG antibody (day 49)

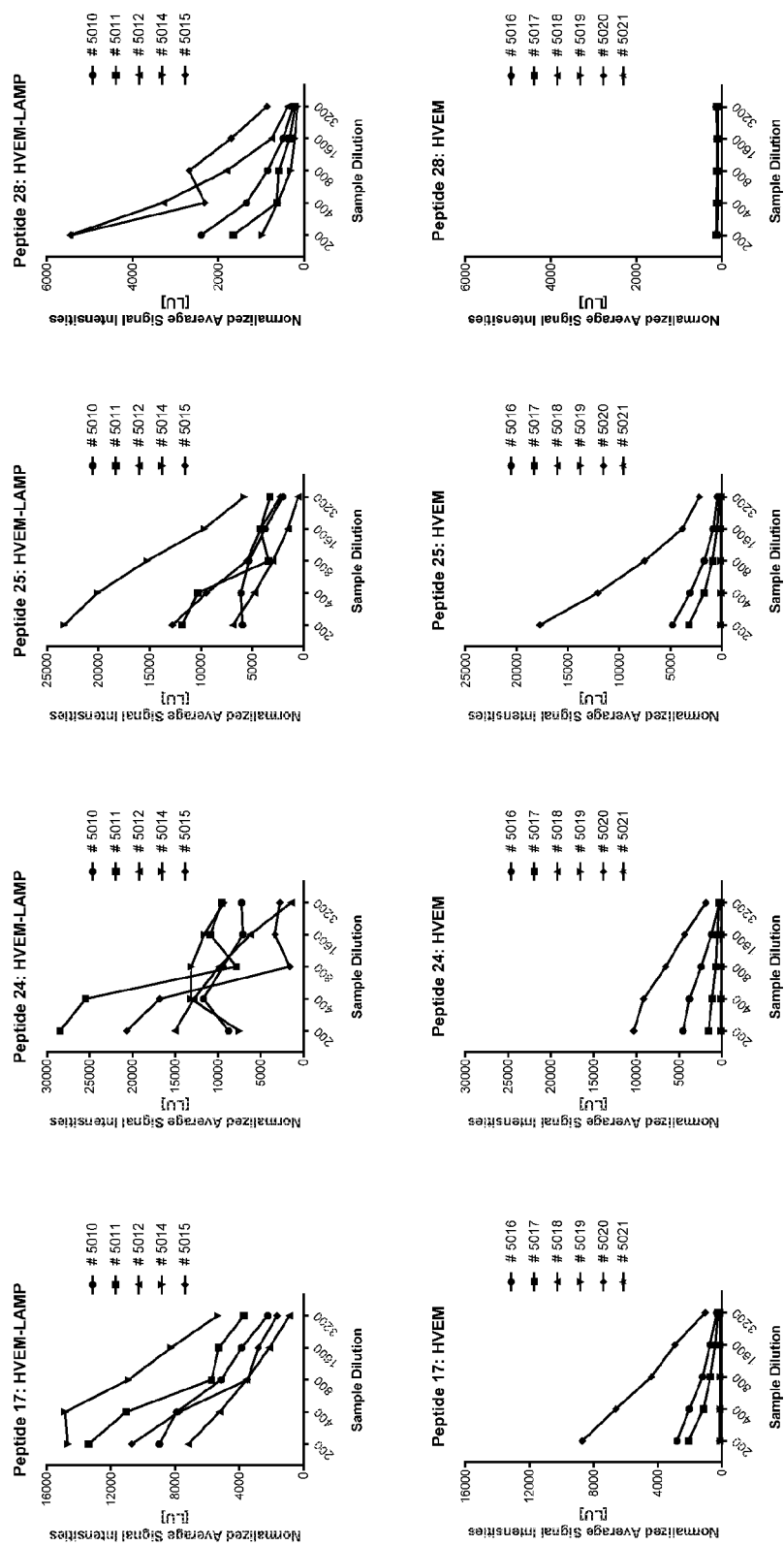

Figure 19

Survivin – Example of a Complete LAMP Construct (SEQ ID NO:193)
maprsarrpllllllllllglmhcasaa*MFMVKNGNGTACIMANFSAAFSVNYDTKSGPKNMTLDLPSDATVVLNRSSCGKENTSDP*
*SLVIAFGRGHTLTLNFTRNATRYSVQLMSFVYNLSDTHLFPNASSKEIKTVESITDIRADIDKKYRCVSGTQVHMNNVTVTLH*
*DATIQAYLSNSSFSRGETRCEQDRPSPTTAPPAPPSPSPSPVPKSPSVDKYNVSGTNGTCLLASMGLQLNLTYERKDNTTVTR*
*LLNINPNKTSASGSCGAHLVTLELHSEGTTVLLFQFGMNASSSRFFLQGIQLNTILPDARDPAFKAANGSLRALQATVGNSYK*
*CNAEEHVRVTKAFSVNIFKVWVQAFKVEGGQFGSVEECLLDENSLE*MGAPTLPPAWQPFLKDHRISTFKNWPFLEGCAC
TPERMAEAGFIHCPTENEPDLAQCFFCFKELEGWEPDDDPIEEHKKHSSGCAFLSVKKQFEELTLGEFLKLDRERAKNKIA
KETNNKKKEFEETAKKVRRAIEQLAAMDEFTLIPIAVGGALAGLVLIVLIAYLVGRKRSHAGYQTI

Survivin – Example of a ILC-1 Construct (SEQ ID NO:194)
maprsarrpllllllllllglmhcasaMGAPTLPPAWQPFLKDHRISTFKNWPFLEGCACTPERMAEAGFIHCPTENEPDLAQCFFC
FKELEGWEPDDDPIEEHKKHSSGCAFLSVKKQFEELTLGEFLKLDRERAKNKIAKETNNKKKEFEETAKKVRRAIEQLAAM
D*AMFMVKNGNGTACIMANFSAAFSVNYDTKSGPKNMTLDLPSDATVVLNRSSCGKENTSDPSLVIAFGRGHTLTLNFTRN*
*ATRYSVQLMSFVYNLSDTHLFPNASSKEIKTVESITDIRADIDKKYRCVSGTQVHMNNVTVTLHDATIQAYLSNSSFSRGETR*
*CEQDRPSPTTAPPAPPSPSPSPVPKSPSVDKYNVSGTNGTCLLASMGLQLNLTYERKDNTTVTRLLNINPNKTSASGSCGAH*
*LVTLELHSEGTTVLLFQFGMNASSSRFFLQGIQLNTILPDARDPAFKAANGSLRALQATVGNSYKCNAEEHVRVTKAFSVNIF*
*KVWVQAFKVEGGQFGSVEECLLDENSM*LIPIAVGGALAGLVLIVLIAYLVGRKRSHAGYQTI

Survivin – Example of a ILC-2 Construct (SEQ ID NO:195)
maprsarrpllllllllllglmhcasaMGAPTLPPAWQPFLKDHRISTFKNWPFLEGCACTPERMAEAGFIHCPTENEPDLAQCFFCF
KELEGWEPDDDPIEEHKKHSSGCAFLSVKKQFEELTLGEFLKLDRERAKNKIAKETNNKKKEFEETAKKVRRAIEQLAAMDA
*MFMVKNGNGTACIMANFSAAFSVNYDTKSGPKNMTLDLPSDATVVLNRSSCGKENTSDPSLVIAFGRGHTLTLNFTRNAT*
*RYSVQLMSFVYNLSDTHLFPNASSKEIKTVESITDIRADIDKKYRCVSGTQVHMNNVTVTLHDATIQAYLSNSSFSRGETRCE*
*QDL*IPIAVGGALAGLVLIVLIAYLVGRKRSHAGYQTI

Survivin – Example of a ILC-3 Construct (SEQ ID NO:196)
maprsarrpllllllllllglmhcasa*AMFMVKNGNGTACIMANFSAAFSVNYDTKSGPKNMTLDLPSDATVVLNRSSCGKENTSDP*
*SLVIAFGRGHTLTLNFTRNATRYSVQLMSFVYNLSDTHLFPNASSKEIKTVESITDIRADIDKKYRCVSGTQVHMNNVTVTLH*
*DATIQAYLSNSSFSRGETRCEQDLE*MGAPTLPPAWQPFLKDHRISTFKNWPFLEGCACTPERMAEAGFIHCPTENEPDLAQ
CFFCFKELEGWEPDDDPIEEHKKHSSGCAFLSVKKQFEELTLGEFLKLDRERAKNKIAKETNNKKKEFEETAKKVRRAIEQLAA
MDEFTLIPIAVGGALAGLVLIVLIAYLVGRKRSHAGYQTI

Survivin – Example of a ILC-4 Construct (SEQ ID NO:197)
maprsarrpllllllllllglmhcasa*AMFMVKNGNGTACIMANFSAAFSVNYDTKSGPKNMTLDLPSDATVVLNRSSCGKENTSDP*
*SLVIAFGRGHTLTLNFTRNATRYSVQLMSFVYNLSDTHLFPNASSKEIKTVESITDIRADIDKKYRCVSGTQVHMNNVTVTLH*
*DATIQAYLSNSSFSRGETRCEQDLE*MGAPTLPPAWQPFLKDHRISTFKNWPFLEGCACTPERMAEAGFIHCPTENEPDLA
QCFFCFKELEGWEPDDDPIEEHKKHSSGCAFLSVKKQFEELTLGEFLKLDRERAKNKIAKETNNKKKEFEETAKKVRRAIEQ
LAAMDE*FTCLLASMGLQLNLTYERKDNTTVTRLLNINPNKTSASGSCGAHLVTLELHSEGTTVLLFQFGMNASSSRFFLQG*
*IQLNTILPDARDPAFKAANGSLRALQATVGNSYKCNAEEHVRVTKAFSVNIFKVWVQAFKVEGGQFGSVEECLLDENSM*
LIPIAVGGALAGLVLIVLIAYLVGRKRSHAGYQTI

Figure 20

>SEQIDNO:114; pp65; Accession No.: ABQ23593; Amino Acids 1-561
MESRGRRCPEMISVLGPISGHVLKAVFSRGDTPVLPHETRLLQTGIHVRVSQPSLILVSQYTPDSTPCHRGDNQLQ
VQHTYFTGSEVENVSVNVHNPTGRSICPSQEPMSIYVYALPLKMLNIPSINVHHYPSAAERKHRHLPVADAVIHAS
GKQMWQARLTVSGLAWTRQQNQWKEPDVYYTSAFVFPTKDVALRHVVCAHELVCSMENTRATKMQVIGDQYVKVYL
ESFCEDVPSGKLFMHVTLGSDVEEDLTMTRNPQPFMRPHERNGFTVLCPKNMIIKPGKISHIMLDVAFTSHEHFGL
LCPKSIPGLSISGNLLMNGQQIFLEVQAIRETVELRQYDPVAALFFFDIDLLLQRGPQYSEHPTFTSQYRIQGKLE
YRHTWDRHDEGAAQGDDDVWTSGSDSDEELVTTERKTPRVTGGGAMAGASTSAGRKRKSASSATACTSGVMTRGRL
KAESTVAPEEDTDEDSDNEIHNPAVFTWPPWQAGILARNLVPMVATVQGQNLKYQEFFWDANDIYRIFAELEGVWQ
PAAQPKRRRHRQDALPGPCIASTPKKHRG

Representative pp65 LAMP Construct Insert: pp65 epitopes (highlighted above) separated by a GPGPG linker (SEQ ID NO:115)
LLQTGIHVRVSQPSLGPGPGALPLKMLNIPSINVHGPGPGDQYVKVYLESFCEDVGPGPGIIKPGKISHIMLDVAF
TSHGPGPGPQYSEHPTFTSQYRIQGKLGPGPGPPWQAGILARNLVPMVGPGPGKYQEFFWDANDIYRIFA

Representative pp65 LAMP Construct Insert: pp65 epitopes (highlighted above) separated by a PMGLP linker (SEQ ID NO:116)
LLQTGIHVRVSQPSLPMGLPALPLKMLNIPSINVHPMGLPDQYVKVYLESFCEDVPMGLPIIKPGKISHIMLDVAF
TSHPMGLPPQYSEHPTFTSQYRIQGKLPMGLPPPWQAGILARNLVPMVPMGLPKYQEFFWDANDIYRIFA

>SEQIDNO:117; gB; Amino Acids 1-906 of Accession No. P06473 Human herpesvirus 5 strain AD169
MESRIWCLVVCVNLCIVCLGAAVSSSSTSHATSSTHNGSHTSRTTSAQTRSVYSQHVTSSEAVSHRANETIYNTTL
KYGDVVGVNTTKYPYRVCSMAQGTDLIRFERNIICTSMKPINEDLDEGIMVVYKRNIVAHTFKVRVYQKVLTFRRS
YAYIYTTYLLGSNTEYVAPPMWEIHHINKFAQCYSSYSRVIGGTVFVAYHRDSYENKTMQLIPDDYSNTHSTRYVT
VKDQWHSRGSTWLYRETCNLNCMLTITTARSKYPYHFFATSTGDVVYISPFYNGTNRNASYFGENADKFFIFPNYT
IVSDFGRPNAAPETHRLVAFLERADSVISWDIQDEKNVTCQLTFWEASERTIRSEAEDSYHFSSAKMTATFLSKKQ
EVNMSDSALDCVRDEAINKLQQIFNTSYNQTYEKYGNVSVFETSGGLVVFWQGIKQKSLVELERLANRSSLNITHR
TRRSTSDNNTTHLSSMESVHNLVYAQLQFTYDTLRGYINRALAQIAEAWCVDQRRTLEVFKELSKINPSAILSAIY
NKPIAARFMGDVLGLASCVTINQTSVKVLRDMNVKESPGRCYSRPVVIFNFANSSYVQYGQLGEDNEILLGNHRTE
ECQLPSLKIFIAGNSAYEYVDYLFKRMIDLSSISTVDSMIALDIDPLENTDFRVLELYSQKELRSSNVFDLEEIMR
EFNSYKQRVKYVEDKVVDPLPPYLKGLDDLMSGLGAAGKAVGVAIGAVGGAVASVVEGVATFLKNPFGAFTIILVA
IAVVIITYLIYTRQRRLCTQPLQNLFPYLVSADGTTVTSGSTKDTSLQAPPSYEESVYNSGRKGPGPPSSDASTAA
PPYTNEQAYQMLLALARLDAEQRAQQNGTDSLDGQTGTQDKGQKPNLLDRLRHKNGYRHLKDSDEEENV

>SEQIDNO:118; gB fragment of Accession No. P06473 Human herpesvirus 5 strain AD169
VSSSSTSHATSSTHNGSHTSRTTSAQTRSVYSQHVTSSEAVSHRANETIYNTTLKYGDVVGVNTTKYPYRVCSMAQ
GTDLIRFERNIICTSMKPINEDLDEGIMVVYKRNIVAHTFKVRVYQKVLTFRRSYAYIYTTYLLGSNTEYVAPPMW
EIHHINKFAQCYSSYSRVIGGTVFVAYHRDSYENKTMQLIPDDYSNTHSTRYVTVKDQWHSRGSTWLYRETCNLNC
MLTITTARSKYPYHFFATSTGDVVYISPFYNGTNRNASYFGENADKFFIFPNYTIVSDFGRPNAAPETHRLVAFLE
RADSVISWDIQDEKNVTCQLTFWEASERTIRSEAEDSYHFSSAKMTATFLSKKQEVNMSDSALDCVRDEAINKLQQ
IFNTSYNQTYEKYGNVSVFETSGGLVVFWQGIKQKSLVELERLANRSSLNITHRTRRSTSDNNTTHLSSMESVHNL
VYAQLQFTYDTLRGYINRALAQIAEAWCVDQRRTLEVFKELSKINPSAILSAIYNKPIAARFMGDVLGLASCVTIN
QTSVKVLRDMNVKESPGRCYSRPVVIFNFANSSYVQYGQLGEDNEILLGNHRTEECQLPSLKIFIAGNSAYEYVDY
LFKRMIDLSSISTVDSMIALDIDPLENTDFRVLELYSQKELRSSNVFDLEEIMREFNSYKQRVKYVEDKVVDPLPP
YLKGLDDLMSGLGAAGKAVGVAIGAVGGAVASVVEGVATFLKNPTRQRRLCTQPLQNLFPYLVSADGTTVTSGSTK
DTSLQAPPSYEESVYNSGRKGPGPPSSDASTAAPPYTNEQAYQMLLALARLDAEQRAQQNGTDSLDGQTGTQDKGQ
KPNLLDRLRHRKNGYRHLKDSDEEENV FIGURE 20 cont.

SEQ ID NO:119: Representative gB LAMP Construct Insert: gB epitopes (highlighted above) separated by a GPGPG linker
TTSAQTRSVYSQHVTGPGPGQLIPDDYSNTHSTRYVGPGPGVSVFETSGGLVVFWQGPGPGNSAYEYVDYLFKRMI
DLS

SEQ ID NO:120: Representative gB LAMP Construct Insert: gB epitopes (highlighted above) separated by a PMGLP linker
TTSAQTRSVYSQHVTPMGLPQLIPDDYSNTHSTRYVPMGLPVSVFETSGGLVVFWQPMGLPNSAYEYVDYLFKRMI
DLS

>SEQIDNO:121; IE1; Amino Acids 1-491 of Accession No. P13202 Human herpesvirus 5 strain AD169
MESSAKRKMDPDNPDEGPSSKVPRPETPVTKATTFLQTMLRKEVNSQLSLGDPLFPELAEESLKTFEQVTEDCNEN
PEKDVLAELVKQIKVRVDMVRHRIKEHMLKKYTQTEEKFTGAFNMMGGCLQNALDILDKVHEPFEEMKCIGLTMQS
MYENYIVPEDKREMWMACIKELHDVSKGAANKLGGALQAKARAKKDELRRKMMYMCYRNIEFFTKNSAFPKTTNGC
SQAMAALQNLPQCSPDEIMAYAQKIFKILDEERDKVLTHIDHIFMDILTTCVETMCNEYKVTSDACMMTMYGGISL
LSEFCRVLCCYVLEETSVMLAKRPLITKPEVISVMKRRIEEICMKVFAQYILGADPLRVCSPSVDDLRAIAEESDE
EEAIVAYTLATAGVSSSDSLVSPPESPVPATIPLSSVIVAENSDQEESEQSDEEEEEGAQEEREDTVSVKSEPVSE
IEEVAPEEEEDGAEEPTASGGKSTHPMVTRSKADQ

SEQ ID NO:122: Representative IE1 LAMP Construct Insert: IE1 epitopes (highlighted above) separated by a GPGPG linker
VLAELVKQIKVRVDMVRHRIKEHMLKKYTQGPGPGIVPEDKREMWMACIKELHGPGPGKDELRRKMMYMCYRNIEF
FTKNSAFPKTTGPGPGSVMKRRIEEICMKVFAQYIGPGPGAIAEESDEEEAIVAYGPGPGVKSEPVSEIEEVAPEE
EEDG

SEQ ID NO:123: Representative IE1 LAMP Construct Insert: IE1 epitopes (highlighted above) separated by a PMGLP linker
VLAELVKQIKVRVDMVRHRIKEHMLKKYTQPMGLPIVPEDKREMWMACIKELHPMGLPKDELRRKMMYMCYRNIEF
FTKNSAFPKTTPMGLPSVMKRRIEEICMKVFAQYIPMGLPAIAEESDEEEAIVAYPMGLPVKSEPVSEIEEVAPEE
EEDG

>SEQIDNO:124; Morphological transforming region II; Amino acids 1-79 of AAA66543 Human betaherpesvirus 5
MLSVMVSSSLVLIVFFLGASEEAKPATTTTIKNTKPQCRPEDYATRLQDLRVTFHRVKPTLVGHVGTVYCDGLSFP
RVG

>SEQIDNO:125; Representative Morphological transforming region II LAMP Construct Insert
ATTTTIKNTKPQCRPEDYATRLQDLRVTFHRVKPTLVGHVGTVYCDGLSFPRVG

>SEQIDNO:126; US28; Amino Acids 1-364 of AMJ53524 Human betaherpesvirus 5
MTPTTTTAELTTEFDYDEDATPCVFTDVLNQSKPVTLFLYGVVFLFGSIGNFLVIFTITWRRRIQCSGDVYFINLA
AADLLFVCTLPLWMQYLLDHNSLASVPCTLLTACFYVAMFASLCFITEIALDRYYAIVYMRYRPVKQACLFSIFWW
IFAVIIAIPHFMVVTKKDNQCMTDYDYLEVSYPIILNVELMLGAFVIPLSVISYCYYRISRIVAVSQSRHKGRIVR
VLIAVVLVFIIFWLPYHLTLFVDTLKLLKWISSSCEFERSLKRALILTESLAFCHCCLNPLLYVFVGTKFRQELHC
LLAEFRQRLFSRDVSWYHSMSFSRRSSPSRRETSSDTLSDEVCRVSQIIP

>SEQIDNO:127; Representative US28 LAMP Construct Insert

FIGURE 20 cont.

MTPTTTTAELTTEFDYDEDATPCVFTDVLNQSKPVTTWRRRIQCSGDDHNSLEIALDRYYAIVYMRYRPVKQTKKD
NQCMTDYDYLEVSYPRISRIVAVSQSRHKGRIVRDTLKLLKWISSSCEFERSLKRGTKFRQELHCLLAEFRQRLFS
RDVSWYHSMSFSRRSSPSRRETSSDTLSDEVCRVSQIIP

>SEQIDNO:128 NP_000588.2 insulin-like growth factor-binding protein 2
isoform a precursor [Homo sapiens]
MLPRVGCPALPLPPPPLLPLLPLLLLLLGASGGGGGARAEVLFRCPPCTPERLAACGPPPVAPPAAVAAVAGGARM
PCAELVREPGCGCCSVCARLEGEACGVYTPRCGQGLRCYPHPGSELPLQALVMGEGTCEKRRDAEYGASPEQVADN
GDDHSEGGLVENHVDSTMNMLGGGGSAGRKPLKSGMKELAVFREKVTEQHRQMGKGGKHHLGLEEPKKLRPPPART
PCQQELDQVLERISTMRLPDERGPLEHLYSLHIPNCDKHGLYNLKQCKMSLNQRGECWCVNPNTGKLIQGAPTIRG
DPECHLFYNEQQEARGVHTQRMQ >SEQIDNO:129 sp|P17150|IL10H_HCMVA Viral interleukin-10 homolog OS=Human
cytomegalovirus (strain AD169) GN=UL111A PE=1 SV=2
MLSVMVSSSLVLIVFFLGASEEAKPATTTIKNTKPQCRPEDYATRLQDLRVTFHRVKPTLQREDDYSVWLDGTVVK
GCWGCSVMDWLLRRYLEIVFPAGDHVYPGLKTELHSMRSTLESIYKDMRQCPLLGCGDKSVISRLSQEAERKSDNG
TRKGLSELDTLFSRLEEYLHSRK >SEQ ID NO:130 - Representative HCMVA Viral interleukin-10 LAMP Construct
Insert
ATTTIKNTKPQCRPEDYATRLQDLRVTFHRVKPTLQREDDYSVWLDGTVVKGCWGCSVMDWLLRRYLEIVFPAGDH
VYPGLKTELHSMRSTLESIYKDMRQCPLLGCGDKSVISRLSQEAERKSDNGTRKGLSELDTLFSRLEEYLHSRK >SEQ ID NO:131; sp|F5HAM0|UL144_HCMVM Membrane glycoprotein UL144 OS=Human
cytomegalovirus (strain Merlin) GN=UL144 PE=3 SV=1
MKPLVMLICFGVILLQLGVTKVCQHNEVQLGNECCPPCGLGQRVTKVCTERTSVTCTPCPNGTYVSGLYNCTDCTQ
CNVTQVMIRNCTSTNNTVCAPKNHTYFSTPGVQHHKQRQQNHTAHITVKQGKSGRHTLAWLSLFIFLVGIILLILY
LIAAYRSERCQQCCSIGKIFYRTL >SEQIDNO:132: Representative HCMVM Membrane glycoprotein UL144 LAMP
Construct Insert
KVCQHNEVQLGNECCPPCGLGQRVTKVCTERTSVTCTPCPNGTYVSGLYNCTDCTQCNVTQVMIRNCTSTNNTVCA
PKNHTYFSTPGVQHHKQRQQNHTAHITVKQGKSGRHTAAYRSERCQQCCSIGKIFYRTL >SEQ ID NO:133; sp|Q6RJQ3|UL141_HCMVM Protein UL141 OS=Human cytomegalovirus
(strain Merlin) GN=UL141 PE=1 SV=1
MCRRESLRTLPWLFWVLLSCPRLLEYSSSSFPFATADIAEKMWAENYETTSPAPVLVAEGEQVTIPCTVMTHSWPM
VSIRARFCRSHDGSDELILDAVKGHRLMNGLQYRLPYATWNFSQLHLGQIFSLTFNVSTDTAGMYECVLRNYSHGL
IMQRFVILTQLETLSRPDEPCCTPALGRYSLGDQIWSPTPWRLRNHDCGMYRGFQRNYFYIGRADAEDCWKPACPD
EEPDRCWTVIQRYRLPGDCYRSQPHPPKFLPVTPAPPADIDTGMSPWATRGIAAFLGFWSIFTVCFLCYLCYLQCC
GRWCPTPGRGRRGGEGYRRLPTYDSYPGVKKMKR > SEQ ID NO:134: Representative HCMVM Protein UL141 LAMP Construct Insert
DIAEKMWAENYETTSPAPVLVAEGEQVTIPCTVMTHSWPMVSIRARFCRSHDGSDELILDAVKGHRLMNGLQYRLP
YATWNFSQLHLGQIFSLTFNVSTDTAGMYECVLRNYSHGLIMQRFVILTQLETLSRPDEPCCTPALGRYSLGDQIW
SPTPWRLRNHDCGMYRGFQRNYFYIGRADAEDCWKPACPDEEPDRCWTVIQRYRLPGDCYRSQPHPPKFLPVTPAP
PADIDTGMSPWATRYLQCCGRWCPTPGRGRRGGEGYRRLPTYDSYPGVKKMKR >SEQIDNO:135: sp|P09727|US11_HCMVA Unique short US11 glycoprotein OS=Human
cytomegalovirus (strain AD169) GN=US11 PE=1 SV=1

FIGURE 20 cont.

MNLVMLILALWAPVAGSMPELSLTLFDEPPPLVETEPLPPLSDVSEYRVEYSEARCVLRSGGRLEALWTLRGNLSV
PTPTPRVYYQTLEGYADRVPTPVEDVSESLVAKRYWLRDYRVPQRTKLVLFYFSPCHQCQTYYVECEPRCLVPWVP
LWSSLEDIERLLFEDRRLMAYYALTIKSAQYTLMMVAVIQVFWGLYVKGWLHRHFPWMFSDQW

>SEQIDNO:136:  Representative HCMVA Unique short US11 glycoprotein LAMP
Construct Insert
MPELSLTLFDEPPPLVETEPLPPLSDVSEYRVEYSEARCVLRSGGRLEALWTLRGNLSVPTPTPRVYYQTLEGYAD
RVPTPVEDVSESLVAKRYWLRDYRVPQRTKLVLFYFSPCHQCQTYYVECEPRCLVPWVPLWSSLEDIERLLFEDRR
LMAYYALTIKSAQYHRHFPWMFSDQW >SEQIDNO:137:  tr|A0A0G2TM81|A0A0G2TM81_HCMV Envelope glycoprotein H
OS=Human cytomegalovirus GN=UL75 PE=3 SV=1
MRPGLPSYLIVLAVCLLSHLLSPRYGAEAVSEPLDKAFHLLLNTYGRPIRFLRENATQCTYNSSLRNSTVVRENAI
SFNFFQSYNQYYVFHMPRCLFAGPLAEQFLNQVDLTETLERYQQRLNTYALVSKDLASYRSFSQQLKAQDSLGEQP
TTVPPPIDLSIPHVWMPPQTTPHGWTESHTTSGLHRPHFNQTCILFDGHDLLFSTVTPCLHQGFYLIDELRYVKIT
LTEDFFVVTVSIDDDTPMLLIFGHLPRVLFKAPYQRDNFILRQTEKHELLVLVKKDQLNRHSYLKDPDFLDAALDF
NYLDLSALLRNSFHRYAVDVLKSGRCQMLDRRTVEMAFAYALALFAAARQEEAGAQVSVPRALDRQAALLQIQEFM
ITCLSQTPPRTTLLLYPTAVDLAKRALWTPNQITDITSLVRLVYILSKQNQQHLIPQWALRQIADFALKLHKTHLA
SFLSAFARQELYLMGSLVHSMLVHTTERREIFIVETGLCSLAELSHFTQLLAHPHHEYLSDLYTPCSSSGRRDHSL
ERLTRLFPDATVPTTVPTALSILSTMQPSTLETFPDLFCLPLGESFSALTVSEHVSYVVTNQYLIKGISYPVSTTV
VGQSLIITQTDSQSKCELTRNMHTTHSITAALNISLENCAFCQSALLEYDDTQGVINIMYMHDSDDVLFALDPYNE
VVVSSPRTHYLMLLKNGTVLEVTDVVVDATDSRLLMMSVYALSAIIGIYLLYRMLKTC >SEQIDNO:138 HCMV Envelope glycoprotein H fragment
VSEPLDKAFHLLLNTYGRPIRFLRENATQCTYNSSLRNSTVVRENAISFNFFQSYNQYYVFHMPRCLFAGPLAEQF
LNQVDLTETLERYQQRLNTYALVSKDLASYRSFSQQLKAQDSLGEQPTTVPPPIDLSIPHVWMPPQTTPHGWTESH
TTSGLHRPHFNQTCILFDGHDLLFSTVTPCLHQGFYLIDELRYVKITLTEDFFVVTVSIDDDTPMLLIFGHLPRVL
FKAPYQRDNFILRQTEKHELLVLVKKDQLNRHSYLKDPDFLDAALDFNYLDLSALLRNSFHRYAVDVLKSGRCQML
DRRTVEMAFAYALALFAAARQEEAGAQVSVPRALDRQAALLQIQEFMITCLSQTPPRTTLLLYPTAVDLAKRALWT
PNQITDITSLVRLVYILSKQNQQHLIPQWALRQIADFALKLHKTHLASFLSAFARQELYLMGSLVHSMLVHTTERR
EIFIVETGLCSLAELSHFTQLLAHPHHEYLSDLYTPCSSSGRRDHSLERLTRLFPDATVPTTVPTALSILSTMQPS
TLETFPDLFCLPLGESFSALTVSEHVSYVVTNQYLIKGISYPVSTTVVGQSLIITQTDSQSKCELTRNMHTTHSIT
AALNISLENCAFCQSALLEYDDTQGVINIMYMHDSDDVLFALDPYNEVVVSSPRTHYLMLLKNGTVLEVTDVVVDA
TDSRRMLKTC >SEQIDNO:139 Representative HCMV Envelope glycoprotein epitopes (highlighted
above)LAMP Construct Insert separated by a GPGPG linker
TYNSSLRNSTVVRENAISFNFFQSYNQYYVFHMPRGPGPGDLTETLERYQQRLNTYALVSKDLASYRSFSGPGPGS
HTTSGLHRPHFNQTCILFDGPGPGQLNRHSYLKDPDFLDAALDF >SEQIDNO:140 Representative HCMV Envelope glycoprotein epitopes (highlighted
above)LAMP Construct Insert separated by a PMGLP linker
TYNSSLRNSTVVRENAISFNFFQSYNQYYVFHMPRPMGLPDLTETLERYQQRLNTYALVSKDLASYRSFSPMGLPS
HTTSGLHRPHFNQTCILFDPMGLPQLNRHSYLKDPDFLDAALDF >SEQIDNO:141: sp|Q6SWP7|VIE2_HCMVT Viral transcription factor IE2 OS=Human
cytomegalovirus (strain Towne) GN=UL122 PE=1 SV=1
MESSAKRKMDPDNPDEGPSSKVPRPETPVTKATTFLQTMLRKEVNSQLSLGDPLFPELAEESLKTFERVTEDCNEN
PEKDVLAELGDILAQAVNHAGIDSSSTGPTLTTHSCSVSSAPLNKPTPTSVAVTNTPLPGASATPELSPRKKPRKT
TRPFKVIIKPPVPPAPIMLPLIKQEDIKPEPDFTIQYRNKIIDTAGCIVISDSEEEQGEEVETRGATASSPSTGSG
TPRVTSPTHPLSQMNHPPLPDPLGRPDEDSSSSSSCSSASDSESESEEMKCSSGGGASVTSSHHGRGGFGGAASS
SLLSCGHQSSGGASTGPRKKKSKRISELDNEKVRNIMKDKNTPFCTPNVQIRRGRVKIDEVSRMFRNTNRSLEYKN FIGURE 20 cont.

```
LPFTIPSMHQVLDEAIKACKTMQVNNKGIQIIYTRNHEVKSEVDAVRCRLGTMCNLALSTPFLMEHTMPVTHPPEV
AQRTADACNEGVKAAWSLKELHTHQLCPRSSDYRNMIIHAATPVDLLGALNLCLPLMQKFPKQVMVRIFSTNQGGF
MLPIYETAAKAYAVGQFEQPTETPPEDLDTLSLAIEAAIQDLRNKSQ
```

>SEQIDNO:142: Representative Viral transcription factor IE2 LAMP Construct Insert with IE2 epitopes (highlighted above) separated by a GPGPG linker
```
RRGRVKIDEVSRMFRGPGPGGIQIIYTRNHEVKSEGPGPGLSTPFLMEHTMPVTHPPEVA
```

>SEQIDNO:143: Representative Viral transcription factor IE2 LAMP Construct Insert with IE2 epitopes (highlighted above) separated by a PMGLP linker
```
RRGRVKIDEVSRMFRPMGLPGIQIIYTRNHEVKSEPMGLPLSTPFLMEHTMPVTHPPEVA
```

>SEQIDNO:144 NP_937983.2 telomerase reverse transcriptase isoform 1 [Homo sapiens]
```
MPRAPRCRAVRSLLRSHYREVLPLATFVRRLGPQGWRLVQRGDPAAFRALVAQCLVCVPWDARPPPAAPSFRQVSC
LKELVARVLQRLCERGAKNVLAFGFALLDGARGGPPEAFTTSVRSYLPNTVTDALRGSGAWGLLLRRVGDDVLVHL
LARCALFVLVAPSCAYQVCGPPLYQLGAATQARPPPHASGPRRRLGCERAWNHSVREAGVPLGLPAPGARRRGGSA
SRSLPLPKRPRRGAAPEPERTPVGQGSWAHPGRTRGPSDRGFCVVSPARPAEEATSLEGALSGTRHSHPSVGRQHH
AGPPSTSRPPRPWDTPCPPVYAETKHFLYSSGDKEQLRPSFLLSSLRPSLTGARRLVETIFLGSRPWMPGTPRRLP
RLPQRYWQMRPLFLELLGNHAQCPYGVLLKTHCPLRAAVTPAAGVCAREKPQGSVAAPEEEDTDPRRLVQLLRQHS
SPWQVYGFVRACLRRLVPPGLWGSRHNERRFLRNTKKFISLGKHAKLSLQELTWKMSVRDCAWLRRSPGVGCVPAA
EHRLREEILAKFLHWLMSVYVVELLRSFFYVTETTFQKNRLFFYRKSVWSKLQSIGIRQHLKRVQLRELSEAEVRQ
HREARPALLTSRLRFIPKPDGLRPIVNMDYVVGARTFRREKRAERLTSRVKALFSVLNYERARRPGLLGASVLGLD
DIHRAWRTFVLRVRAQDPPPELYFVKVDVTGAYDTIPQDRLTEVIASIIKPQNTYCVRRYAVVQKAAHGHVRKAFK
SHVSTLTDLQPYMRQFVAHLQETSPLRDAVVIEQSSSLNEASSGLFDVFLRFMCHHAVRIRGKSYVQCQGIPQGSI
LSTLLCSLCYGDMENKLFAGIRRDGLLLRLVDDFLLVTPHLTHAKTFLRTLVRGVPEYGCVVNLRKTVVNFPVEDE
ALGGTAFVQMPAHGLFPWCGLLLDTRTLEVQSDYSSYARTSIRASLTFNRGFKAGRNMRRKLFGVLRLKCHSLFLD
LQVNSLQTVCTNIYKILLLQAYRFHACVLQLPFHQQVWKNPTFFLRVISDTASLCYSILKAKNAGMSLGAKGAAGP
LPSEAVQWLCHQAFLLKLTRHRVTYVPLLGSLRTAQTQLSRKLPGTTLTALEAAANPALPSDFKTILD
```

>SEQIDNO:145: telomerase reverse transcriptase short fragment 1 168-1132 amino acids that can be inserted into the Improved and Complete LAMP Constructs Described herein
```
YQVCGPPLYQLGAATQARPPPHASGPRRRLGCERAWNHSVREAGVPLGLPAPGARRRGGSASRSLPLPKRPRRGAA
PEPERTPVGQGSWAHPGRTRGPSDRGFCVVSPARPAEEATSLEGALSGTRHSHPSVGRQHHAGPPSTSRPPRPWDT
PCPPVYAETKHFLYSSGDKEQLRPSFLLSSLRPSLTGARRLVETIFLGSRPWMPGTPRRLPRLPQRYWQMRPLFLE
LLGNHAQCPYGVLLKTHCPLRAAVTPAAGVCAREKPQGSVAAPEEEDTDPRRLVQLLRQHSSPWQVYGFVRACLRR
LVPPGLWGSRHNERRFLRNTKKFISLGKHAKLSLQELTWKMSVRDCAWLRRSPGVGCVPAAEHRLREEILAKFLHW
LMSVYVVELLRSFFYVTETTFQKNRLFFYRKSVWSKLQSIGIRQHLKRVQLRELSEAEVRQHREARPALLTSRLRF
IPKPDGLRPIVNMDYVVGARTFRREKRAERLTSRVKALFSVLNYERARRPGLLGASVLGLDDIHRAWRTFVLRVRA
QDPPPELYFVKVDVTGAYDTIPQDRLTEVIASIIKPQNTYCVRRYAVVQKAAHGHVRKAFKSHVSTLTDLQPYMRQ
FVAHLQETSPLRDAVVIEQSSSLNEASSGLFDVFLRFMCHHAVRIRGKSYVQCQGIPQGSILSTLLCSLCYGDMEN
KLFAGIRRDGLLLRLVDDFLLVTPHLTHAKTFLRTLVRGVPEYGCVVNLRKTVVNFPVEDEALGGTAFVQMPAHGL
FPWCGLLLDTRTLEVQSDYSSYARTSIRASLTFNRGFKAGRNMRRKLFGVLRLKCHSLFLDLQVNSLQTVCTNIYK
ILLLQAYRFHACVLQLPFHQQVWKNPTFFLRVISDTASLCYSILKAKNAGMSLGAKGAAGPLPSEAVQWLCHQAFL
LKLTRHRVTYVPLLGSLRTAQTQLSRKLPGTTLTALEAAANPALPSDFKTILD
```

>SEQIDNO:146: telomerase reverse transcriptase fragment 2 that can be inserted into the Improved and Complete LAMP Constructs Described herein
```
MPRAPRCRAVRSLLRSHYREVLPLATFVRRLGPQGWRLVQRGDPAAFRALVAQCLVCVPWDARPPPAAPSFRQVSC
LKELVARVLQRLCERGAKNVLAFGFALLDGARGGPPEAFTTSVRSYLPNTVTDALRGSGAWGLLLRRVGDDGPPLY
```

FIGURE 20 cont.

```
QLGAATQARPPPHASGPRRRLGCERAWNHSVREAGVPLGLPAPGARRRGGSASRSLPLPKRPRRGAAPEPERTPVG
QGSWAHPGRTRGPSDRGFCVVSPARPAEEATSLEGALSGTRHSHPSVGRQHHAGPPSTSRPPRPWDTPCPPVYAET
KHFLYSSGDKEQLRPSFLLSSLRPSLTGARRLVETIFLGSRPWMPGTPRRLPRLPQRYWQMRPLFLELLGNHAQCP
YGVLLKTHCPLRAAVTPAAGVCAREKPQGSVAAPEEEDTDPRRLVQLLRQHSSPWQVYGFVRACLRRLVPPGLWGS
RHNERRFLRNTKKFISLGKHAKLSLQELTWKMSVRDCAWLRRSPGVGCVPAAEHRLREEILAKFLHWLMSVYVVEL
LRSFFYVTETTFQKNRLFFYRKSVWSKLQSIGIRQHLKRVQLRELSEAEVRQHREARPALLTSRLRFIPKPDGLRP
IVNMDYVVGARTFRREKRAERLTSRVKALFSVLNYERARRPGLLGASVLGLDDIHRAWRTFVLRVRAQDPPPELYF
VKVAITGAYDTIPQDRLTEVIASIIKPQNTYCVRRYAVVQKAAHGHVRKAFKSHVSTLTDLQPYMRQFVAHLQETS
PLRDAVVIEQSSSLNEASSGLFDVFLRFMCHHAVRIRGKSYVQENKLFAGIRRDGLLLRLVDDFLLVTPHLTHAKT
FLRTLVRGVPEYGCVVNLRKTVVNFPVEDEALDTRTLEVQSDYSSYARTSIRASLTFNRGFKAGRNMRRKLFGVLR
LKCHSLFLDLQVNSLQTVCTNIYKILLLQAYRFHACVLQLPFHQQVWKNPTFFLRVISDTASLCYSILKAKNAGMS
LGAKGAAGPLPSEAVQWLCHQAFLLKLTRHRVTYVPLLGSLRTAQTQLSRKLPGTTLTALEAAANPALPSDFKTIL
D
```

>SEQIDNO:147 Survivin; Amino Acids 1-142 of Accession Number NP_001125727;
baculoviral IAP repeat-containing protein 5
```
MGAPTLPPAWQPFLKDHRISTFKNWPFLEGCACTPERMAEAGFIHCPTENEPDLAQCFFCFKELEGWEPDDDPIEE
HKKHSSGCAFLSVKKQFEELTLGEFLKLDRERAKNKIAKETNNKKKEFEETAKKVRRAIEQLAAMD
```

>SEQIDNO:148 1AF9_A Chain A, Tetanus Neurotoxin C Fragment
```
MKNLDCWVDNEEDIDVILKKSTILNLDINNDIISDISGFNSSVITYPDAQLVPGINGKAIHLVNNESSEVIVHKAM
DIEYNDMFNNFTVSFWLRVPKVSASHLEQYGTNEYSIISSMKKHSLSIGSGWSVSLKGNNLIWTLKDSAGEVRQIT
FRDLPDKFNAYLANKWVFITITNDRLSSANLYINGVLMGSAEITGLGAIREDNNITLKLDRCNNNNQYVSIDKFRI
FCKALNPKEIEKLYTSYLSITFLRDFWGNPLRYDTEYYLIPVASSSKDVQLKNITDYMYLTNAPSYTNGKLNIYYR
RLYNGLKFIIKRYTPNNEIDSFVKSGDFIKLYVSYNNNEHIVGYPKDGNAFNNLDRILRVGYNAPGIPLYKKMEAV
KLRDLKTYSVQLKLYDDKNASLGLVGTHNGQIGNDPNRDILIASNWYFNHLKDKILGCDWYFVPTDEGWTND
```

> Representative Tetanus Neurotoxin C LAMP Construct Insert: Tetanus
Neurotoxin C epitopes (highlighted above) separated by a GPGPG linker (SEQ
ID NO:149)
```
PGINGKAIHLVNNESSEGPGPGFNNFTVSFWLRVPKVSASHLEQYGTGPGPGYVSIDKFRIFCKALNPKEIEKLYT
SYLSGPGPGILRVGYNAPGIPLYKKMEAVKLRDLK
```

> Representative Tetanus Neurotoxin C LAMP Construct Insert: Tetanus
Neurotoxin C epitopes (highlighted above) separated by a PMGLP linker (SEQ
ID NO:150)
```
PGINGKAIHLVNNESSEPMGLPFNNFTVSFWLRVPKVSASHLEQYGTPMGLPYVSIDKFRIFCKALNPKEIEKLYT
SYLSPMGLPILRVGYNAPGIPLYKKMEAVKLRDLK
```

>NP_001318.1 cancer/testis antigen 1 [Homo sapiens](SEQ ID NO:151)
```
MQAEGRGTGGSTGDADGPGGPGIPDGPGGNAGGPGEAGATGGRGPRGAGAARASGPGGGAPRGPHGGAASGLNGCC
RCGARGPESRLLEFYLAMPFATPMEAELARRSLAQDAPPLPVPGVLLKEFTVSGNILTIRLTAADHRQLQLSISSC
LQQLSLLMWITQCFLPVFLAQPPSGQRR
```

NY-ESO-1 1-155 of SEQ ID NO:151 (SEQ ID NO: 167)
```
MQAEGRGTGGSTGDADGPGGPGIPDGPGGNAGGPGEAGATGGRGPRGAGAARASGPGGGAPRGPHGGAASGLNGCC
RCGARGPESRLLEFYLAMPFATPMEAELARRSLAQDAPPLPVPGVLLKEFTVSGNILTIRLTAADHRQLQLSISSC
LQQQRR
```

FIGURE 20 cont.

NY-ESO-1 80-155 of SEQ ID NO:151 (SEQ ID NO: 168)

ARGPESRLLEFYLAMPFATPMEAELARRSLAQDAPPLPVPGVLLKEFTVSGNILTIRLTAADHRQLQLSISSCLQQ
QRR

>AAA75493.1 HER2 receptor [Homo sapiens](SEQ ID NO:152)
MELAALCRWGLLLALLPPGAASTQVCTGTDMKLRLPASPETHLDMLRHLYQGCQVVQGNLELTYLPTNASLSFLQD
IQEVQGYVLIAHNQVRQVPLQRLRIVRGTQLFEDNYALAVLDNGDPLNNTTPVTGASPGGLRELQLRSLTEILKGG
VLIQRNPQLCYQDTILWKDIFHKNNQLALTLIDTNRSRACHPCSPMCKGSRCWGESSEDCQSLTRTVCAGGCARCK
GPLPTDCCHEQCAAGCTGPKHSDCLACLHFNHSGICELHCPALVTYNTDTFESMPNPEGRYTFGASCVTACPYNYL
STDVGSCTLVCPLHNQEVTAEDGTQRCEKCSKPCARVCYGLGMEHLREVRAVTSANIQEFAGCKKIFGSLAFLPES
FDGDPASNTAPLQPEQLQVFETLEEITGYLYISAWPDSLPDLSVFQNLQVIRGRILHNGAYSLTLQGLGISWLGLR
SLRELGSGLALIHHNTHLCFVHTVPWDQLFRNPHQALLHTANRPEDECVGEGLACHQLCARGHCWGPGPTQCVNCS
QFLRGQECVEECRVLQGLPREYVNARHCLPCHPECQPQNGSVTCFGPEADQCVACAHYKDPPFCVARCPSGVKPDL
SYMPIWKFPDEEGACQPCPINCTHSCVDLDDKGCPAEQRASPLTSIVSAVVGILLVVVLGVVFGILIKRRQQKIRK
YTMRRLLQETELVEPLTPSGAMPNQAQMRILKETELRKVKVLGSGAFGTVYKGIWIPDGENVKIPVAIKVLRENTS
PKANKEILDEAYVMAGVGSPYVSRLLGICLTSTVQLVTQLMPYGCLLDHVRENRGRLGSQDLLNWCMQIAKGMSYL
EDVRLVHRDLAARNVLVKSPNHVKITDFGLARLLDIDETEYHADGGKVPIKWMALESILRRRFTHQSDVWSYGVTV
WELMTFGAKPYDGIPAREIPDLLEKGERLPQPPICTIDVYMIMVKCWMIDSECRPRFRELVSEFSRMARDPQRFVV
IQNEDLGPASPLDSTFYRSLLEDDDMGDLVDAEEYLVPQQGFFCPDPAPGAGGMVHHRHRSSSTRSGGGDLTLGLE
PSEEEAPRSPLAPSEGAGSDVFDGDLGMGAAKGLQSLPTHDPSPLQRYSEDPTVPLPSETDGYVAPLTCSPQPEYV
NQPDVRPQPPSPREGPLPAARPAGATLERAKTLSPGKNGVVKDVFAFGGAVENPEYLTPQGGAAPQPHPPPAFSPA
FDNLYYWDQDPPERGAPPSTFKGTPTAENPEYLGLDVPV Representative HER2 Construct (SEQ ID NO:153) comprising amino acids 23-652
and 690-1255 of SEQ ID NO:152

TQVCTGTDMKLRLPASPETHLDMLRHLYQGCQVVQGNLELTYLPTNASLSFLQDIQEVQGYVLIAHNQVRQVPLQR
LRIVRGTQLFEDNYALAVLDNGDPLNNTTPVTGASPGGLRELQLRSLTEILKGGVLIQRNPQLCYQDTILWKDIFH
KNNQLALTLIDTNRSRACHPCSPMCKGSRCWGESSEDCQSLTRTVCAGGCARCKGPLPTDCCHEQCAAGCTGPKHS
DCLACLHFNHSGICELHCPALVTYNTDTFESMPNPEGRYTFGASCVTACPYNYLSTDVGSCTLVCPLHNQEVTAED
GTQRCEKCSKPCARVCYGLGMEHLREVRAVTSANIQEFAGCKKIFGSLAFLPESFDGDPASNTAPLQPEQLQVFET
LEEITGYLYISAWPDSLPDLSVFQNLQVIRGRILHNGAYSLTLQGLGISWLGLRSLRELGSGLALIHHNTHLCFVH
TVPWDQLFRNPHQALLHTANRPEDECVGEGLACHQLCARGHCWGPGPTQCVNCSQFLRGQECVEECRVLQGLPREY
VNARHCLPCHPECQPQNGSVTCFGPEADQCVACAHYKDPPFCVARCPSGVKPDLSYMPIWKFPDEEGACQPCPINC
THSCVDLDDKGCPAEQRASPLTLLQETELVEPLTPSGAMPNQAQMRILKETELRKVKVLGSGAFGTVYKGIWIPDG
ENVKIPVAIAVLRENTSPKANKEILDEAYVMAGVGSPYVSRLLGICLTSTVQLVTQLMPYGCLLDHVRENRGRLGS
QDLLNWCMQIAKGMSYLEDVRLVHRDLAARNVLVKSPNHVKITDFGLARLLDIDETEYHADGGKVPIKWMALESIL
RRRFTHQSDVWSYGVTVWELMTFGAKPYDGIPAREIPDLLEKGERLPQPPICTIDVYMIMVKCWMIDSECRPRFRE
LVSEFSRMARDPQRFVVIQNEDLGPASPLDSTFYRSLLEDDDMGDLVDAEEYLVPQQGFFCPDPAPGAGGMVHHRH
RSSSTRSGGGDLTLGLEPSEEEAPRSPLAPSEGAGSDVFDGDLGMGAAKGLQSLPTHDPSPLQRYSEDPTVPLPSE
TDGYVAPLTCSPQPEYVNQPDVRPQPPSPREGPLPAARPAGATLERAKTLSPGKNGVVKDVFAFGGAVENPEYLTP
QGGAAPQPHPPPAFSPAFDNLYYWDQDPPERGAPPSTFKGTPTAENPEYLGLDVPV

Second Representative HER2 Construct (SEQ ID NO:154) comprising amino acids
23-632 of SEQ ID NO:152.
TQVCTGTDMKLRLPASPETHLDMLRHLYQGCQVVQGNLELTYLPTNASLSFLQDIQEVQGYVLIAHNQVRQVPLQR
LRIVRGTQLFEDNYALAVLDNGDPLNNTTPVTGASPGGLRELQLRSLTEILKGGVLIQRNPQLCYQDTILWKDIFH FIGURE 20 cont.

KNNQLALTLIDTNRSRACHPCSPMCKGSRCWGESSEDCQSLTRTVCAGGCARCKGPLPTDCCHEQCAAGCTGPKHS
DCLACLHFNHSGICELHCPALVTYNTDTFESMPNPEGRYTFGASCVTACPYNYLSTDVGSCTLVCPLHNQEVTAED
GTQRCEKCSKPCARVCYGLGMEHLREVRAVTSANIQEFAGCKKIFGSLAFLPESFDGDPASNTAPLQPEQLQVFET
LEEITGYLYISAWPDSLPDLSVFQNLQVIRGRILHNGAYSLTLQGLGISWLGLRSLRELGSGLALIHHNTHLCFVH
TVPWDQLFRNPHQALLHTANRPEDECVGEGLACHQLCARGHCWGPGPTQCVNCSQFLRGQECVEECRVLQGLPREY
VNARHCLPCHPECQPQNGSVTCFGPEADQCVACAHYKDPPFCVARCPSGVKPDLSYMPIWKFPDEEGACQPCPINC
TH

>NP_001973.2 receptor tyrosine-protein kinase erbB-3 isoform 1 precursor
[Homo sapiens](SEQ ID NO:155)
MRANDALQVLGLLFSLARGSEVGNSQAVCPGTLNGLSVTGDAENQYQTLYKLYERCEVVMGNLEIVLTGHNADLSF
LQWIREVTGYVLVAMNEFSTLPLPNLRVVRGTQVYDGKFAIFVMLNYNTNSSHALRQLRLTQLTEILSGGVYIEKN
DKLCHMDTIDWRDIVRDRDAEIVVKDNGRSCPPCHEVCKGRCWGPGSEDCQTLTKTICAPQCNGHCFGPNPNQCCH
DECAGGCSGPQDTDCFACRHFNDSGACVPRCPQPLVYNKLTFQLEPNPHTKYQYGGVCVASCPHNFVVDQTSCVRA
CPPDKMEVDKNGLKMCEPCGGLCPKACEGTGSGSRFQTVDSSNIDGFVNCTKILGNLDFLITGLNGDPWHKIPALD
PEKLNVFRTVREITGYLNIQSWPPHMHNFSVFSNLTTIGGRSLYNRGFSLLIMKNLNVTSLGFRSLKEISAGRIYI
SANRQLCYHHSLNWTKVLRGPTEERLDIKHNRPRRDCVAEGKVCDPLCSSGGCWGPGPGQCLSCRNYSRGGVCVTH
CNFLNGEPREFAHEAECFSCHPECQPMEGTATCNGSGSDTCAQCAHFRDGPHCVSSCPHGVLGAKGPIYKYPDVQN
ECRPCHENCTQGCKGPELQDCLGQTLVLIGKTHLTMALTVIAGLVVIFMMLGGTFLYWRGRRIQNKRAMRRYLERG
ESIEPLDPSEKANKVLARIFKETELRKLKVLGSGVFGTVHKGVWIPEGESIKIPVCIKVIEDKSGRQSFQAVTDHM
LAIGSLDHAHIVRLLGLCPGSSLQLVTQYLPLGSLLDHVRQHRGALGPQLLLNWGVQIAKGMYYLEEHGMVHRNLA
ARNVLLKSPSQVQVADFGVADLLPPDDKQLLYSEAKTPIKWMALESIHFGKYTHQSDVWSYGVTVWELMTFGAEPY
AGLRLAEVPDLLEKGERLAQPQICTIDVYMVMVKCWMIDENIRPTFKELANEFTRMARDPPRYLVIKRESGPGIAP
GPEPHGLTNKKLEEVELEPELDLDLDLEAEEDNLATTTLGSALSLPVGTLNRPRGSQSLLSPSSGYMPMNQGNLGE
SCQESAVSGSSERCPRPVSLHPMPRGCLASESSEGHVTGSEAELQEKVSMCRSRSRSRSPRPRGDSAYHSQRHSLL
TPVTPLSPPGLEEEDVNGYVMPDTHLKGTPSSREGTLSSVGLSSVLGTEEEDEDEEYEYMNRRRHSPPHPPRPSS
LEELGYEYMDVGSDLSASLGSTQSCPLHPVPIMPTAGTTPDEDYEYMNRQRDGGGPGGDYAAMGACPASEQGYEEM
RAFQGPGHQAPHVHYARLKTLRSLEATDSAFDNPDYWHSRLFPKANAQRT Representative HER3 Construct (SEQ ID NO:156) comprising amino acids 20-643,
665-1201, and 1209-1342 of SEQ ID NO:155
SEVGNSQAVCPGTLNGLSVTGDAENQYQTLYKLYERCEVVMGNLEIVLTGHNADLSFLQWIREVTGYVLVAMNEFS
TLPLPNLRVVRGTQVYDGKFAIFVMLNYNTNSSHALRQLRLTQLTEILSGGVYIEKNDKLCHMDTIDWRDIVRDRD
AEIVVKDNGRSCPPCHEVCKGRCWGPGSEDCQTLTKTICAPQCNGHCFGPNPNQCCHDECAGGCSGPQDTDCFACR
HFNDSGACVPRCPQPLVYNKLTFQLEPNPHTKYQYGGVCVASCPHNFVVDQTSCVRACPPDKMEVDKNGLKMCEPC
GGLCPKACEGTGSGSRFQTVDSSNIDGFVNCTKILGNLDFLITGLNGDPWHKIPALDPEKLNVFRTVREITGYLNI
QSWPPHMHNFSVFSNLTTIGGRSLYNRGFSLLIMKNLNVTSLGFRSLKEISAGRIYISANRQLCYHHSLNWTKVLR
GPTEERLDIKHNRPRRDCVAEGKVCDPLCSSGGCWGPGPGQCLSCRNYSRGGVCVTHCNFLNGEPREFAHEAECFS
CHPECQPMEGTATCNGSGSDTCAQCAHFRDGPHCVSSCPHGVLGAKGPIYKYPDVQNECRPCHENCTQGCKGPELQ
DCLGQTLVLIGKTHLTYWRGRRIQNKRAMRRYLERGESIEPLDPSEKANKVLARIFKETELRKLKVLGSGVFGTVH
KGVWIPEGESIKIPVCIKVIEDKSGRQSFQAVTDHMLAIGSLDHAHIVRLLGLCPGSSLQLVTQYLPLGSLLDHVR
QHRGALGPQLLLNWGVQIAKGMYYLEEHGMVHRNLAARNVLLKSPSQVQVADFGVADLLPPDDKQLLESEAKTPIK
WMALESIHFGKYTHQSDVWSYGVTVWELMTFGAEPYAGLRLAEVPDLLEKGERLAQPQICTIDVYMVMVKCWMIDE
NIRPTFKELANEFTRMARDPPRYLVIKRESGPGIAPGPEPHGLTNKKLEEVELEPELDLDLDLEAEEDNLATTTLG
SALSLPVGTLNRPRGSQSLLSPSSGYMPMNQGNLGESCQESAVSGSSERCPRPVSLHPMPRGCLASESSEGHVTGS
EAELQEKVSMCRSRSRSRSPRPRGDSAYHSQRHSLLTPVTPLSPPGLEEEDVNGYVMPDTHLKGTPSSREGTLSSV
GLSSVLGTEEEDEDEEYEYMNPHPPRPSSLEELGYEYMDVGSDLSASLGSTQSCPLHPVPIMPTAGTTPDEDYEYM
NRQRDGGGPGGDYAAMGACPASEQGYEEMRAFQGPGHQAPHVHYARLKTLRSLEATDSAFDNPDYWHSRLFPKANA
QRT

FIGURE 20 cont.

Second Representative Construct of HER3 (SEQ ID NO:157) comprising amino acids 20-643 of SEQ ID NO:155

SEVGNSQAVCPGTLNGLSVTGDAENQYQTLYKLYERCEVVMGNLEIVLTGHNADLSFLQWIREVTGYVLVAMNEFS
TLPLPNLRVVRGTQVYDGKFAIFVMLNYNTNSSHALRQLRLTQLTEILSGGVYIEKNDKLCHMDTIDWRDIVRDRD
AEIVVKDNGRSCPPCHEVCKGRCWGPGSEDCQTLTKTICAPQCNGHCFGPNPNQCCHDECAGGCSGPQDTDCFACR
HFNDSGACVPRCPQPLVYNKLTFQLEPNPHTKYQYGGVCVASCPHNFVVDQTSCVRACPPDKMEVDKNGLKMCEPC
GGLCPKACEGTGSGSRFQTVDSSNIDGFVNCTKILGNLDFLITGLNGDPWHKIPALDPEKLNVFRTVREITGYLNI
QSWPPHMHNFSVFSNLTTIGGRSLYNRGFSLLIMKNLNVTSLGFRSLKEISAGRIYISANRQLCYHHSLNWTKVLR
GPTEERLDIKHNRPRRDCVAEGKVCDPLCSSGGCWGPGPGQCLSCRNYSRGGVCVTHCNFLNGEPREFAHEAECFS
CHPECQPMEGTATCNGSGSDTCAQCAHFRDGPHCVSSCPHGVLGAKGPIYKYPDVQNECRPCHENCTQGCKGPELQ
DCLGQTLVLIGKTHLT

>NP_003811.2 tumor necrosis factor receptor superfamily member 14 isoform 1 precursor [Homo sapiens] (SEQ ID NO:158)
MEPPGDWGPPPWRSTPKTDVLRLVLYLTFLGAPCYAPALPSCKEDEYPVGSECCPKCSPGYRVKEACGELTGTVCE
PCPPGTYIAHLNGLSKCLQCQMCDPAMGLRASRNCSRTENAVCGCSPGHFCIVQDGDHCAACRAYATSSPGQRVQK
GGTESQDTLCQNCPPGTFSPNGTLEECQHQTKCSWLVTKAGAGTSSSHWVWWFLSGSLVIVIVCSTVGLIICVKRR
KPRGDVVKVIVSVQRKRQEAEGEATVIEALQAPPDVTTVAVEETIPSFTGRSPNH

Representative HVEM Construct (SEQ ID NO:159) comprising amino acids 39-202 of SEQ ID NO:158
LPSCKEDEYPVGSECCPKCSPGYRVKEACGELTGTVCEPCPPGTYIAHLNGLSKCLQCQMCDPAMGLRASRNCSRT
ENAVCGCSPGHFCIVQDGDHCAACRAYATSSPGQRVQKGGTESQDTLCQNCPPGTFSPNGTLEECQHQTKCSWLVT
KAGAGTSSSHWV

HPV Constructs

Representative HPV 16 E6-E7 Construct (SEQ ID NO:164) separated by a GPGPG linker
<u>MHQKRTAMFQDPQESGRKLPQLCTELQTTIHDIILECVYCKQQLLRREVYDRDLCIVYRDGNPYAVCDKCLKFYSK</u>
<u>ISEYRHYCYSLYGTTLEQQYNKPLCDLLIRCINCQKPLQRHLDKKQRFHNIRGRWTGRCMSCCRSSRTRRETQLG</u>*GP*
*GPG**MHGDTPTLHEYMLDLQPETTDLYGYGQLNDSSEEEDEIDGPAGQAEPDRAHYNIVTFCCKCDSTLRLCVQSTH*
*VDIRTLEDLLMGTLGIVCPICSQKP*

Representative HPV 18 E6-E7 Construct (SEQ ID NO:165) separated by a GPGPG linker
<u>MARFEDPTRSGYKLPDLCTELNTSLQDIEITCVYCKTVLELTEVFEKDLFVVYRDSIPHAACHKCIDFYSRIRELR</u>
<u>HYSDSVYGDTLEKLTNTGLYNLLIRCLRCQKPLLRHLNEKRRFHNIAGHYRGQCHSCCNRARQERLQRRRETQV</u>*GP*
*GPG**MHGPKATLQDIVLHLEPQNEIPVDLLGHGQLSDSEEENDEIDGVNHQHLPARRAEPQRHTMLCMCCKCEARIE*
*LVVESSADDLRAFQQLFLNTLSFVCPWCASQQ*

Representative HPV 16 E6 - linker - HPV 18 E6 - linker - HPV 16 E7 - linker - HPV 18 E7 Construct (SEQ ID NO:166)
<u>MHQKRTAMFQDPQESGRKLPQLCTELQTTIHDIILECVYCKQQLLRREVYDRDLCIVYRDGNPYAVCDKCLKFYSK</u>
<u>ISEYRHYCYSLYGTTLEQQYNKPLCDLLIRCINCQKPLQRHLDKKQRFHNIRGRWTGRCMSCCRSSRTRRETQLG</u>*GP*
*GPG*MARFEDPTRSGYKLPDLCTELNTSLQDIEITCVYCKTVLELTEVFEKDLFVVYRDSIPHAACHKCIDFYSRIR
ELRHYSDSVYGDTLEKLTNTGLYNLLIRCLRCQKPLLRHLNEKRRFHNIAGHYRGQCHSCCNRARQERLQRRRETQ
V*GPGPG*

FIGURE 20 cont.

▓▓▓▓▓▓▓▓▓▓▓▓▓▓▓▓▓▓▓▓▓▓▓▓▓▓▓▓▓*GPGPG*MHGPKATLQDIVLHLEPQNEIPVDLLGHGQLSDSEEENDEIDG
VNHQHLPARRAEPQRHTMLCMCCKCEARIELVVESSADDLRAFQQLFLNTLSFVCPWCASQQ

Sequences used to create the above constructs

HPV 16 E6 (SEQ ID NO:160) Human papillomavirus type 16
MHQKRTAMFQDPQESGRKLPQLCTELQTTIHDIILECVYCKQQLLRREVYDRDLCIVYRDGNPYAVCDKCLKFYSK
ISEYRHYCYSLYGTTLEQQYNKPLCDLLIRCINCQKPLQRHLDKKQRFHNIRGRWTGRCMSCCRSSRTRRETQL

HPV 18 E6 (SEQ ID NO: 161) Human papillomavirus type 18
MARFEDPTRSGYKLPDLCTELNTSLQDIEITCVYCKTVLELTEVFEKDLFVVYRDSIPHAACHKCIDFYSRIRELR
HYSDSVYGDTLEKLTNTGLYNLLIRCLRCQKPLLRHLNEKRRFHNIAGHYRGQCHSCCNRARQERLQRRRETQV

HPV 16 E7 (SEQ ID NO: 162) Human papillomavirus type 16
MHGDTPTLHEYMLDLQPETTDLYGYGQLNDSSEEEDEIDGPAGQAEPDRAHYNIVTFCCKCDSTLRLCVQSTHVDI
RTLEDLLMGTLGIVCPICSQKP

HPV 18 E7 (SEQ ID NO:163) Human papillomavirus type 18
MHGPKATLQDIVLHLEPQNEIPVDLLGHGQLSDSEEENDEIDGVNHQHLPARRAEPQRHTMLCMCCKCEARIELVV
ESSADDLRAFQQLFLNTLSFVCPWCASQQ

EBV Antigens

EBV EBNA1 full length nuclear antigen EBNA-1 [Human gammaherpesvirus 4] (SEQ ID NO: 169)
MSDEGPGTGPGNGLGEKGDTSGPEGSGGSGPQRRGGDNHGRGRGRGRGRGGGRPGAPGGSGSGPRHRDGVRRPQKR
PSCIGCKGTHGGTGAGAGAGGAGAGGAGAGGGAGAGGGAGGAGGAGGAGAGGGAGAGGGAGGAGGAGAGGGAGAGG
GAGGAGAGGGAGGAGGAGAGGGAGAGGGAGGAGAGGGAGGAGGAGAGGGAGAGGAGGAGGAGAGGAGAGGGAGGAG
GAGAGGAGAGGAGAGGAGGAGAGGAGGAGAGGAGGAGAGGGAGGAGAGGGAGAGGAGGAGAGGAGAGGGAGGAG
AGGAGGAGAGGGAGAGGAGAGGGGRGRGGSGGRGRGGSGGRGRGGSGGRRGRGRERARGGSRERARGRGRGRGEKR
PRSPSSQSSSSGSPPRRPPPGRRPFFHPVGEADYFEYHQEGGPDGEPDVPPGAIEQGPADDPGEGPSTGPRGQGDG
GRRKKGGWFGKHRGQGGSNPKFENIAEGLRALLARSHVERTTDEGTWVAGVFVYGGSKTSLYNLRRGTALAIPQCR
LTPLSRLPFGMAPGPGPQPGPLRESIVCYFMVFLQTHIFAEVLKDAIKDLVMTKPAPTCNIRVTVCSFDDGVDLPP
WFPPMVEGAAAEGDDGDDGDEGGDGDEGEEGQE

EBV EBNA1 truncated nuclear antigen EBNA-1 [Human gammaherpesvirus 4] (SEQ ID NO: 170)
MSDEGPGTGPGNGLGEKGDTSGPEGSGGSGPQRRGGDNHGRGRGRGRGRGGGRPGAPGGSGSGPRHRDGVRRPQKR
PSCIGCKGTHRGRGGSGGRGRGGSGGRRGRGRERARGGSRERARGRGRGRGEKRPRSPSSQSSSSGSPPRRPPPGR
RPFFHPVGEADYFEYHQEGGPDGEPDVPPGAIEQGPADDPGEGPSTGPRGQGDGGRRKKGGWFGKHRGQGGSNPKF
ENIAEGLRALLARSHVERTTDEGTWVAGVFVYGGSKTSLYNLRRGTALAIPQCRLTPLSRLPFGMAPGPGPQPGPL
RESIVCYFMVFLQTHIFAEVLKDAIKDLVMTKPAPTCNIRVTVCSFDDGVDLPPWFPPMVEGAAAEGDDGDDGDEG
GDGDEGEEGQE

EBV gp350 ECD glycoprotein 350 [Human gammaherpesvirus 4] (SEQ ID NO: 171)
MEAALLVCQYTIQSLIHLTGEDPGFFNVEIPEFPFYPTCNVCTADVNVTINFDVGGKKHQLDLDFGQLTPHTKAVY
QPRGAFGGSENATNLFLLELLGAGELALTMRSKKLPINVTTGEEQQVSLESVDVYFQDVFGTMWCHHAEMQNPVYL
IPETVPYIKWDNCNSTNITAVVRAQGLDVTLPLSLPTSAQDSNFSVKTEMLGNEIDIECIMEDGEISQVLPGDNKF

FIGURE 20 cont.

NITCSGYESHVPSGGILTSTSPVATPIPGTGYAYSLRLTPRPVSRFLGNNSILYVFYSGNGPKASGGDYCIQSNIV
FSDEIPASQDMPTNTTDITYVGDNATYSVPMVTSEDANSPNVTVTAFWAWPNNTETDFKCKWTLTSGTPSGCENIS
GAFASNRTFDITVSGLGTAPKTLIITRTATNATTTHKVIFSKAPESTTTSPTLNTTGFADPNTTTGLPSSTHVPT
NLTAPASTGPTVSTADVTSPTPAGTTSGASPVTPSPSPWDNGTESKAPDMTSSTSPVTTPTPNATSPTPAVTTPTP
NATSPTPAVTTPTPNATSPTLGKTSPTSAVTTPTPNATSPTLGKTSPTSAVTTPTPNATSPTLGKTSPTSAVTTPT
PNATGPTVGETSPQANATNHTLGGTSPTPVVTSQPKNATSAVTTGQHNITSSSTSSMSLRPSSNPETLSPSTSDNS
TSHMPLLTSAHPTGGENITQVTPASISTHHVSTSSPAPRPGTTSQASGPGNSSTSTKPGEVNVTKGTPPQNATSPQ
APSGQKTAVPTVTSTGGKANSTTGGKHTTGHGARTSTEPTTDYGGDSTTPRPRYNATTYLPPSTSSKLRPRWTFTS
PPVTTAQATVPVPPTSQPRFSNLS

EBV LMP2 membrane protein LMP-2A [Human gammaherpesvirus 4] (SEQ ID NO: 172)
MGSLEMVPMGAGPPSPGGDPDGYDGGNNSQYPSASGSSGNTPTPPNDEERESNEEPPPPYEDPYWGNGDRHSDYQP
LGTQDQSLYLGLQHDGNDGLPPPPYSPRDDSSQHIYEEAGRGSMNPVCLPVIVAPYLFWLAAIAASCFTASVSTVV
TATGLALSLLLLAAVASSYAAAQRKLLTPVTVLTAVVTFFAICLTWRIEDPPFNSLLFALLAAAGGLQGIYVLVML
VLLILAYRRRWRRLTVCGGIMFLACVLVLIVDAVLQLSPLLGAVTVVSMTLLLLAFVLWLSSPGGLGTLGAALLTL
AAALALLASLILGTLNLTTMFLLMLLWTLVVLLICSSCSSCPLSKILLARLFLYALALLLLASALIAGGSILQTNF
KSLSSTEFIPNLFCMLLLIVAGILFILAILTEWGSGNRTYGPVFMCLGGLLTMVAGAVWLTVMSNTLLSAWILTAG
FLIFLIGFALFGVIRCCRYCCYYCLTLESEERPPTPYRNTV

GCP3 glypican-3 isoform 2 precursor [Homo sapiens] (SEQ ID NO: 173)
AQPPPPPPDATCHQVRSFFQRLQPGLKWVPETPVPGSDLQVCLPKGPTCCSRKMEEKYQLTARLNMEQLLQSASME
LKFLIIQNAAVFQEAFEIVVRHAKNYTNAMFKNNYPSLTPQAFEFVGEFFTDVSLYILGSDINVDDMVNELFDSLF
PVIYTQLMNPGLPDSALDINECLRGARRDLKVFGNFPKLIMTQVSKSLQVTRIFLQALNLGIEVINTTDHLKFSKD
CGRMLTRMWYCSYCQGLMMVKPCGGYCNVVMQGCMAGVVEIDKYWREYILSLEELVNGMYRIYDMENVLLGLFSTI
HDSIQYVQKNAGKLTTTIGKLCAHSQQRQYRSAYYPEDLFIDKKVLKVAHVEHEETLSSRRRELIQKLKSFISFYS
ALPGYICSHSPVAENDTLCWNGQELVERYSQKAARNGMKNQFNLHELKMKGPEPVVSQIIDKLKHINQLLRTMSMP
KGRVLDKNLDEEGFESGDCGDDEDECIGGSGDGMIKVKNQLRFLAELAYDLDVDDAPGNSQQATPKDNEISTFHNL
GNVHSPLK

Middle S Protein (HBV) middle envelope protein [Hepatitis B virus] (SEQ ID NO: 174)
MQWNSTTFHQTLQDPRVRGLYFPAGGSSSGTVNPVLTTASPLSSIFSRIGDPALNMENITSGTIPQSLDSWWTSLN
FLGGTTVCLGQNSQSPTSNHSPTSCPPTCPGYRWMCLRRDYQGMLPVCPLIPGSSTTSTGPCRTCMTTAQGTSMYP
SCCCTKPSDGNCTCIPIPSSWAFGKFLWEWASARYWGPSX

X Protein (HBV) X protein [Hepatitis B virus] (SEQ ID NO: 175)
MAARLCCQLDPARDVLCLRPVGAESRGRPLSGPLGALPSPSPSAVPADHGAHLSLRGLPVCAFSSAGPCALRFTSA
RRMETTVNAHQILPKVLHKRTFGLSAMSTTDLEAYFKDCVFKDW

TIGIT hypothetical protein, partial [Homo sapiens] 99% homology to TIGIT isoform 6, partial [Pongo abeliii] (SEQ ID NO: 176)
MMTGTIETTGNISAEKGGSIILQCHLSSTTAQVTQVNWEQQDQLLAICNADLGWHISPSFKDRVAPGPGLGLTLQS
LTVNDTGEYFCIYHTYPDGTYTGRIFLEVLESSVAEHGARFQIP

TEM8 anthrax toxin receptor 1 isoform 1 precursor [Homo sapiens] (SEQ ID NO: 177)
EDGGPACYGGFDLYFILDKSGSVLHHWNEIYYFVEQLAHKFISPQLRMSFIVFSTRGTTLMKLTEDREQIRQGLEE
LQKVLPGGDTYMHEGFERASEQIYYENRQGYRTASVIIALTDGELHEDLFFYSEREANRSRDLGAIVYCVGVKDFN
ETQLARIADSKDHVFPVNDGFQALQGIIHSILKKSCIEILAAEPSTICAGESFQVVVRGNGFRHARNVDRVLCSFK
INDSVTLNEKPFSVEDTYLLCPAPILKEVGMKAALQVSMNDGLSFISSSVIITTTHCSDGS

FIGURE 20 cont.

TEM1 endosialin precursor [Homo sapiens] (SEQ ID NO: 178)
QDPWAAEPRAACGPSSCYALFPRRRTFLEAWRACRELGGDLATPRTPEEAQRVDSLVGAGPASRLLWIGLQRQARQ
CQLQRPLRGFTWTTGDQDTAFTNWAQPASGGPCPAQRCVALEASGEHRWLEGSCTLAVDGYLCQFGFEGACPALQD
EAGQAGPAVYTTPFHLVSTEFEWLPFGSVAAVQCQAGRGASLLCVKQPEGGVGWSRAGPLCLGTGCSPDNGGCEHE
CVEEVDGHVSCRCTEGFRLAADGRSCEDPCAQAPCEQQCEPGGPQGYSCHCRLGFRPAEDDPHRCVDTDECQIAGV
CQQMCVNYVGGFECYCSEGHELEADGISCSPAGAMGAQASQDLGDELLDDGEDEEDEDEAWKAFNGGWTEMPGILW
MEPTQPPDFALAYRPSFPEDREPQIPYPEPTWPPPLSAPRVPYHSSVLSVTRPVVVSATHPTLPSAHQPPVIPATH
PALSRDHQIPVIAANYPDLPSAYQPGILSVSHSAQPPAHQPPMISTKYPELFPAHQSPMFPDTRVAGTQTTTHLPG
IPPNHAPLVTTLGAQLPPQAPDALVLRTQATQLPIIPTAQPSLTTTSRSPVSPAHQISVPAATQPAALPTLLPSQS
PTNQTSPISPTHPHSKAPQIPREDGPSPKLALWLPSPAPTAAPTALGEAGLAEHSQRDDRWLYCTRCGPHAPNKRI
TDCYRWVIHAGSKSPTEPMPPRGSLTGVQTCRTSV

HER2 ECD+TM v-erb-b2 erythroblastic leukemia viral oncogene homolog 2,
neuro/glioblastoma derived oncogene homolog, partial [synthetic construct]
(SEQ ID NO: 179)
TQVCTGTDMKLRLPASPETHLDMLRHLYQGCQVVQGNLELTYLPTNASLSFLQDIQEVQGYVLIAHNQVRQVPLQR
LRIVRGTQLFEDNYALAVLDNGDPLNNTTPVTGASPGGLRELQLRSLTEILKGGVLIQRNPQLCYQDTILWKDIFH
KNNQLALTLIDTNRSRACHPCSPMCKGSRCWGESSEDCQSLTRTVCAGGCARCKGPLPTDCCHEQCAAGCTGPKHS
DCLACLHFNHSGICELHCPALVTYNTDTFESMPNPEGRYTFGASCVTACPYNYLSTDVGSCTLVCPLHNQEVTAED
GTQRCEKCSKPCARVCYGLGMEHLREVRAVTSANIQEFAGCKKIFGSLAFLPESFDGDPASNTAPLQPEQLQVFET
LEEITGYLYISAWPDSLPDLSVFQNLQVIRGRILHNGAYSLTLQGLGISWLGLRSLRELGSGLALIHHNTHLCFVH
TVPWDQLFRNPHQALLHTANRPEDECVGEGLACHQLCARGHCWGPGPTQCVNCSQFLRGQECVEECRVLQGLPREY
VNARHCLPCHPECQPQNGSVTCFGPEADQCVACAHYKDPPFCVARCPSGVKPDLSYMPIWKFPDEEGACQPCPINC
THSCVDLDDKGCPAEQRASPLTSIVSAVVGILLVVVLGVVFGILI

CEA carcinoembryonic antigen-related cell adhesion molecule 5 isoform 1
preproprotein [Homo sapiens] (SEQ ID NO: 180)
KLTIESTPFNVAEGKEVLLLVHNLPQHLFGYSWYKGERVDGNRQIIGYVIGTQQATPGPAYSGREIIYPNASLLIQ
NIIQNDTGFYTLHVIKSDLVNEEATGQFRVYPELPKPSISSNNSKPVEDKDAVAFTCEPETQDATYLWWVNNQSLP
VSPRLQLSNGNRTLTLFNVTRNDTASYKCETQNPVSARRSDSVILNVLYGPDAPTISPLNTSYRSGENLNLSCHAA
SNPPAQYSWFVNGTFQQSTQELFIPNITVNNSGSYTCQAHNSDTGLNRTTVTTITVYAEPPKPFITSNNSNPVEDE
DAVALTCEPEIQNTTYLWWVNNQSLPVSPRLQLSNDNRTLTLLSVTRNDVGPYECGIQNKLSVDHSDPVILNVLYG
PDDPTISPSYTYYRPGVNLSLSCHAASNPPAQYSWLIDGNIQQHTQELFISNITEKNSGLYTCQANNSASGHSRTT
VKTITVSAELPKPSISSNNSKPVEDKDAVAFTCEPEAQNTTYLWWVNGQSLPVSPRLQLSNGNRTLTLFNVTRNDA
RAYVCGIQNSVSANRSDPVTLDVLYGPDTPIISPPDSSYLSGANLNLSCHSASNPSPQYSWRINGIPQQHTQVLFI
AKITPNNNGTYACFVSNLATGRNNSIVKSITVSASGTSPGLSA

TARP TCR gamma alternate reading frame protein isoform 2 [Homo sapiens] (SEQ
ID NO: 181)
MKTNDTYMKFSWLTVPEKSLDKEHRCIVRHENNKNGVDQEIIFPPIKTDVITMDPKDNCSKDANDTLLLQLTNTSA

PROSTEIN solute carrier family 45 member 3 [Homo sapiens] (SEQ ID NO: 182)
MVQRLWVSRLLRHRKAQLPPLLLEVGVEEKSASDHWRGRYGRRRPLAGLLCPDPRPTPLEALLSDLFRDPDHCRQA
DWDTSALAPYLGTQEECEEAALGPTEPAEGLSAPSLSPHCCPCRARLAFRNLGALLPRLHQLCCRMPRTLRRLVGE
GLYQGVPRAEPGTEARRHYDEGVRRLVQRFGTRASVAVVTASYHREKQVFLPKYRGDTGGASSEDSLMTSFLPGPK
PGAPFPNGHVGAGGSGLLPPPPALCGASACDVSVRVVVGEPTEARVVPGRGICLDLAILDSAFLLSQVAPSLFMGS
IVQLSQSVTFDKSDLAKYSA

PSMA prostate-specific membrane antigen [Homo sapiens] (SEQ ID NO: 183)

FIGURE 20 cont.

MWNLLHETDSAVATARRPRWLCKSSNEATNITPKHNMKAFLDELKAENIKKFLYNFTQIPHLAGTEQNFQLAKQIQ
SQWKEFGLDSVELAHYDVLLSYPNKTHPNYISIINEDGNEIFNTSLFEPPPPGYENVSDIVPPFSAFSPQGMPEGD
LVYVNYARTEDFFKLERDMKINCSGKIVIARYGKVFRGNKVKNAQLAGAKGVILYSDPADYFAPGVKSYPDGWNLP
GGGVQRGNILNLNGAGDPLTPGYPANEYAYRRGIAEAVGLPSIPVHPIGYYDAQKLLEKMGGSAPPDSSWRGSLKV
PYNVGPGFTGNFSTQKVKMHIHSTNEVTRIYNVIGTLRGAVEPDRYVILGGHRDSWVFGGIDPQSGAAVVHEIVRS
FGTLKKEGWRPRRTILFASWDAEEFGLLGSTEWAEENSRLLQERGVAYINADSSIEGNYTLRVDCTPLMYSLVHNL
TKELKSPDEGFEGKSLYESWTKKSPSPEFSGMPRISKLGSGNDFEVFFQRLGIASGRARYTKNWETNKFSGYPLYH
SVYETYELVEKFYDPMFKYHLTVAQVRGGMVFELANSIVLPFDCRDYAVVLRKYADKIYSISMKHPQEMKTYSVSF
DSLFSAVKNFTEIASKFSERLQDFDKSNPIVLRMMNDQLMFLERAFIDPLGLPDRPFYRHVIYAPSSHNKYAGESF
PGIYDALFDIESKVDPSKAWGEVKRQIYVAAFTVQAAAETLSEVA

BIRC4 survivin-beta [Homo sapiens] (SEQ ID NO: 184)
MGAPTLPPAWQPFLKDHRISTFKNWPFLEGCACTPERMAEAGFIHCPTENEPDLAQCFFCFKELEGWEPDDDPIGP
GTVAYACNTSTLGGRGGRITREEHKKHSSGCAFLSVKKQFEELTLGEFLKLDRERAKNKIAKETNNKKKEFEETAK
KVRRAIEQLAAMD

MUCIN-1 mucin [Homo sapiens] (SEQ ID NO: 185)
TGSGHASSTPGGEKETSATQRSSVPSSTEKNAVSMTSSVLSSHSPGSGSSTTQGQDVTLAPATEPASGSAATWGQD
VTSVPVTRPALGSTTPPAHDVTSAPDNKPAPGSTAPPAHGVTSAPDTRPAPGSTAPPAHGVTSAPDTRPAPGSTAP
PAHGVTSAPDTRPAPGSTAPPAHGVTSAPDTRPAPGSTAPPAHGVTSAPDTRPAPGSTAPPAHGVTSAPDTRPAPG
STAPPAHGVTSAPDTRPAPGSTAPPAHGVTSAPDTRPAPGSTAPPAHGVTSAPDTRPAPGSTAPPAHGVTSAPDTR
PAPGSTAPPAHGVTSAPDTRPAPGSTAPPAHGVTSAPDTRPAPGSTAPPAHGVTSAPDTRPAPGSTAPPAHGVTSA
PDTRPAPGSTAPPAHGVTSAPDTRPAPGSTAPPAHGVTSAPDTRPAPGSTAPPAHGVTSAPDTRPAPGSTAPPAHG
VTSAPDTRPAPGSTAPPAHGVTSAPDTRPAPGSTAPPAHGVTSAPDTRPAPGSTAPPAHGVTSAPDTRPAPGSTAP
PAHGVTSAPDTRPAPGSTAPPAHGVTSAPDTRPAPGSTAPPAHGVTSAPDTRPAPGSTAPPAHGVTSAPDTRPAPG
STAPPAHGVTSAPDTRPAPGSTAPPAHGVTSAPDTRPAPGSTAPPAHGVTSAPDTRPAPGSTAPPAHGVTSAPDTR
PAPGSTAPPAHGVTSAPDTRPAPGSTAPPAHGVTSAPDTRPAPGSTAPPAHGVTSAPDTRPAPGSTAPPAHGVTSA
PDTRPAPGSTAPPAHGVTSAPDTRPAPGSTAPPAHGVTSAPDTRPAPGSTAPPAHGVTSAPDTRPAPGSTAPPAHG
VTSAPDTRPAPGSTAPPAHGVTSAPDTRPAPGSTAPPAHGVTSAPDTRPAPGSTAPPAHGVTSAPDTRPAPGSTAP
PAHGVTSAPDNRPALGSTAPPVHNVTSASGSASGSASTLVHNGTSARATTTPASKSTPFSIPSHHSDTPTTLASHS
TKTDASSTHHSSVPPLTSSNHSTSPQLSTGVSFFFLSFHISNLQFNSSLEDPSTDYYQELQRDISEMFLQIYKQGG
FLGLSNIKFRPGSVVVQLTLAFREGTINVHDVETQFNQYKTEAASRYNLTISDVSVSDVPFPFSAQSGAGVPG

MUCIN-1 isoform mucin-1 isoform 11 precursor [Homo sapiens] (SEQ ID NO: 186)
TGSGHASSTPGGEKETSATQRSSVPSSTEKNALSTGVSFFFLSFHISNLQFNSSLEDPSTDYYQELQRDISEMFLQ
IYKQGGFLGLSNIKFRPGSVVVQLTLAFREGTINVHDVETQFNQYKTEAASRYNLTISDVSVSDVPFPFSAQSGAG
VPGWGIALLVLVCVLVALAIVYLIALAVCQCRRKNYGQLDIFPARDTYHPMSEYPTYHTHGRYVPPSSTDRSPYEK
VSAGNGGSSLSYTNPAVAATSANL

CD40 Ligand [Homo sapiens] (SEQ ID NO: 187)
MKIFMYLLTVFLITQMIGSALFAVYLHRRLDKIEDERNLHEDFVFMKTIQRCNTGERSLSLLNCEEIKSQFEGFVK
DIMLNKEETKKENSFEMQKGDQNPQIAAHVISEASSKTTSVLQWAEKGYYTMSNNVLTLENGKQLTVKRQGLYYIY
AQVTFCSNREASSQAPFIASLCLKSPGRFERILLRAANTHSSAKPCGQQSIHLGGVFELQPGASVFVNVTDPSQVS
HGTGFTSFGLLKL

WT-1 Wilms tumor protein isoform D [Homo sapiens] (SEQ ID NO: 188)
MGSDVRDLNALLPAVPSLGGGGGCALPVSGAAQWAPVLDFAPPGASAYGSLGGPAPPPAPPPPPPPPHSFIKQEP
SWGGAEPHEEQCLSAFTVHFSGQFTGTAGACRYGPFGPPPPSQASSGQARMFPNAPYLPSCLESQPAIRNQGYSTV
TFDGTPSYGHTPSHHAAQFPNHSFKHEDPMGQQGSLGEQQYSVPPPVYGCHTPTDSCTGSQALLLRTPYSSDNLYQ
MTSQLECMTWNQMNLGATLKGVAAGSSSSVKWTEGQSNHSTGYESDNHTTPILCGAQYRIHTHGVFRGIQDVRRVP

FIGURE 20 cont.

GVAPTLVRSASETSEKRPFMCAYPGCNKRYFKLSHLQMHSRKHTGEKPYQCDFKDCERRFSRSDQLKRHQRRHTGV
KPFQCKTCQRKFSRSDHLKTHTRTHTGKTSEKPFSCRWPSCQKKFARSDELVRHHNMHQRNMTKLQLAL

WT-1 truncated Wilms tumor protein isoform D [Homo sapiens] (SEQ ID NO: 189)
MGSDVRDLNALLPAVPSLGGGGGCALPVSGAAQWAPVLDFAPPGASAYGSLGGPAPPPAPPPPPPPPHSFIKQEP
SWGGAEPHEEQCLSAFTVHFSGQFTGTAGACRYGPFGPPPPSQASSGQARMFPNAPYLPSCLESQPAIRNQGYSTV
TFDGTPSYGHTPSHHAAQFPNHSFKHEDPMGQQGSLGEQQYSVPPPVYGCHTPTDSCTGSQALLLRTPYSSDNLYQ
MTSQLECMTWNQMNLGATLKGVAAGSSSSVKWTEGQSNHSTGYESDNHTTPILCGAQYRIHTHGVFRGIQDVRRVP
GVAPTLVRSASETSEKRP

PRAME preferentially expressed antigen of melanoma [Homo sapiens] (SEQ ID NO: 190)
MERRRLWGSIQSRYISMSVWTSPRRLVELAGQSLLKDEALAIAALELLPRELFPPLFMAAFDGRHSQTLKAMVQAW
PFTCLPLGVLMKGQHLHLETFKAVLDGLDVLLAQEVRPRRWKLQVLDLRKNSHQDFWTVWSGNRASLYSFPEPEAA
QPMTKKRKVDGLSTEAEQPFIPVEVLVDLFLKEGACDELFSYLIEKVKRKKNVLRLCCKKLKIFAMPMQDIKMILK
MVQLDSIEDLEVTCTWKLPTLAKFSPYLGQMINLRRLLLSHIHASSYISPEKEEQYIAQFTSQFLSLQCLQALYVD
SLFFLRGRLDQLLRHVMNPLETLSITNCRLSEGDVMHLSQSPSVSQLSVLSLSGVMLTDVSPEPLQALLERASATL
QDLVFDECGITDDQLLALLPSLSHCSQLTTLSFYGNSISISALQSLLQHLIGLSNLTHVLYPVPLESYEDIHGTLH
LERLAYLHARLRELLCELGRPSMVWLSANPCHCGDRTFYDPEPILCPCFMPN

LAGE-1 cancer/testis antigen 2, isoform CRA_a [Homo sapiens] (SEQ ID NO: 191)
MQAEGQGTGGSTGDADGPGGPGIPDGPGGNAGGPGEAGATGGRGPRGAGAARASGPRGGAPRGPHGGAASAQDGRC
PCGARRPDSRLLQLHITMPFSSPMEAELVRRILSRDAAPLPRPGAVLKDFTVSGNLLFMSVRDQDREGAGRMRVVG
WGLGSASPEGQKARDLRTPKHKVSEQRPGTPGPPPPEGAQGDGCRGVAFNVMFSAPHI

MAGE A3 melanoma-associated antigen 3 [Homo sapiens] (SEQ ID NO: 192)
MPLEQRSQHCKPEEGLEARGEALGLVGAQAPATEEQEAASSSSTLVEVTLGEVPAAESPDPPQSPQGASSLPTTMN
YPLWSQSYEDSSNQEEEGPSTFPDLESEFQAALSRKVAELVHFLLLKYRAREPVTKAEMLGSVVGNWQYFFPVIFS
KASSSLQLVFGIELMEVDPIGHLYIFATCLGLSYDGLLGDNQIMPKAGLLIIVLAIIAREGDCAPEEKIWEELSVL
EVFEGREDSILGDPKKLLTQHFVQENYLEYRQVPGSDPACYEFLWGPRALVETSYVKVLHHMVKISGGPHISYPPL
HEWVLREGEE

LAMP CONSTRUCTS COMPRISING CANCER ANTIGENS

CROSS-REFERENCE TO RELATED APPLICATIONS

This application is a § 371 National Stage Application of PCT/US18/30725 filed on May 2, 2018, which claims priority to U.S. 62/500,053 filed on May 2, 2017 and U.S. 62/561,760 filed on Sep. 22, 2017. All of these documents are hereby incorporated by reference in their entirety.

SEQUENCE LISTING

The present application is filed with a Sequence Listing in electronic format. The Sequence Listing is provided as a file entitled "01305-0008-00US_ST25.txt" created on Jul. 13, 2022, which is 258,867 bytes in size. The information in the electronic format of the sequence listing is incorporated herein by reference in its entirety.

BACKGROUND OF THE INVENTION

Field of the Invention

The invention relates to improved LAMP Constructs comprising cancer antigens and their use in treating subjects suffering from hyperproliferative disorders and/or cancer. Prime boost protocols utilizing the improved LAMP Constructs described herein are also described.

Discussion of the Related Art

In the following discussion, certain articles and methods will be described for background and introductory purposes. Nothing contained herein is to be construed as an "admission" of prior art. Applicant expressly reserves the right to demonstrate, where appropriate, that the articles and methods referenced herein do not constitute prior art under the applicable statutory provisions.

DNA vaccines are new and promising candidates for the development of both prophylactic and therapeutic vaccines. They are proven to be safe and the lack of immune responses to a vector backbone may be a definitive advantage if repetitive cycles of vaccination are required to achieve clinical benefits. However, one perceived disadvantage of conventional DNA vaccines is their low immunogenicity in humans. A key limiting step in the immunogenicity of epitope-based DNA vaccines may be the access of epitopes to the MHCII presentation pathway to T cells, which is likely a stochastic process in the case of a vaccine without targeting technology.

U.S. Pat. No. 5,633,234 describes chimeric proteins comprising an antigenic domain of modified influenza hemagglutinin (HA) and a cytoplasmic endosomal/lysosomal targeting signal which effectively target antigens to that compartment. The antigenic domain was processed and peptides from it presented on the cell surface in association with major histocompatibility (MHC) class II molecules. The cytoplasmic tail of LAMP-1 was used to form the endosomal/lysosomal targeting domain of the chimeric protein.

U.S. Pat. No. 8,318,173 extended these initial observations to describe chimeric proteins (and the corresponding DNAs that encode these proteins) comprising the HIV-1 Gag protein inserted between the full lumenal domain and a transmembrane domain of LAMP-1. This construct was introduced into dendritic cells which were then reported to target the MHC II pathway.

This approach has proved useful in increasing cellular and humoral responses to several virus antigens, human papillomavirus E7, dengue virus membrane protein, HIV-1 gp160 membrane protein, HIV-1 p55 Gag, West Nile membrane protein, hepatitis C virus NS3 protein and cytomegalovirus pp65 (see, e.g., Bonini, et al., J. Immunol. 166:5250-5257, 2001). The enhanced immune response can be attributed to co-localization of LAMP with MHC II and the more efficient processing and delivery of antigenic peptides. In addition, LAMP-targeting is reported to result in the presentation of an increased number of immunogenic epitopes, thus inducing a qualitatively broadened immune response compared to untargeted antigen. For example, Fernandes et al., 2000, Eur. J. Immunol. 30(8): 2333-43, demonstrated an increase in the number of presented peptides of a LAMP-trafficked OVA antigen encoded in a vaccinia vector. Of 12 peptides generated from exogenously supplied OVA, 9 were presented by an OVA/LAMP chimera, as compared to only 2 by the construct without LAMP.

While it has been determined that the cytoplasmic domain of LAMP is necessary (in conjunction with a signal sequence and transmembrane domain), it is not always sufficient for endosomal/lysosomal trafficking of all antigens. Instead, the full lumenal domain of LAMP has been shown to be also required for the trafficking of proteins to the lysosomal vesicular pathway.

However, even with the presence of the complete lumenal domain and the complete transmembrane/cytoplasmic tail of LAMP ("complete LAMP Constructs"), it has increasingly been found that the efficacy of a particular antigen to raise an immune response is highly dependent on the particular sequence used in these constructs. In fact, different antigenic fragments of the same protein when inserted into the complete LAMP constructs have been found to not elicit the same immune response. Sometimes the antigen fragment generates an immune response and other times it does not. These observations make the ability to predict ahead of time which particular antigenic sequence from a protein of interest will raise an immune response difficult with the complete LAMP Constructs.

Moreover, in generating the complete LAMP Constructs, it has been repeatedly observed that the full lumenal domain is required to properly express and process an antigen. For example, in Godinho et al., PLoS ONE 9(6): 9(6): e99887. doi:10.1371/journal.pone.0099887, the authors reported that the complete and intact lumenal domain was the necessary minimal region needed to target an antigen to the lysosomes and that fragments of the lumenal domain did not work. See, id. at page 6.

Specifically, the Godinho authors showed that by completely removing the first luminal domain and some of the second luminal domain (i.e., T1-Lum/gag construct), both protein expression and antibody response is decreased. Similarly, removing 25% of first luminal domain but having an intact second luminal domain (i.e., T2-lum/gag), both protein expression and antibody response comparatively increased but still less than the results obtained with the complete LAMP construct.

Moreover, the authors acknowledged that the ability to raise an immune response is dependent upon the particular antigen and the epitopes used in these complete LAMP Constructs. For example, on page 9, column 2, the authors state "accordingly, previous studies demonstrated that DNA vaccines that generate Gag secreted as VLP, or in a soluble form, induce different levels of T and B cell activation, which were also different from the response induced by cytoplasmic Gag." Moreover, insertion of an antigenic sequence between the full lumenal domain of LAMP and the full transmembrane/cytoplasmic domain of LAMP as has been described in the literature can result in such large polynucleotide sequences that it can become either too costly to produce at commercial levels or impractical from a scientific perspective.

Thus, there is a need to design new and improved LAMP Constructs that can be used as vaccines to effectively treat, for example, hyperproliferative disorders and/or cancer. Moreover, once improved, these new LAMP Constructs can be used to generate antibodies.

SUMMARY OF THE INVENTION

This Summary is provided to introduce a selection of concepts in a simplified form that are further described below in the Detailed Description. This Summary is not intended to identify key or essential features of the claimed subject matter, nor is it intended to be used to limit the scope of the claimed subject matter. Other features, details, utilities, and advantages of the claimed subject matter will be apparent from the following written Detailed Description including those aspects illustrated in the accompanying drawings and defined in the appended claims.

It is an object of this invention to provide novel constructs ("improved LAMP Constructs") comprising specific fragments and/or variants of LAMP domains that effectively present the cancer antigens specified herein to the immune system to generate an enhanced immune response. These improved LAMP Constructs effectively direct the antigens to the lysosomal/endosomal compartment where they are processed and presented to major histocompatibility complex (MHC) class II molecules so that helper T cells are preferentially stimulated and/or antibodies are generated.

The improved LAMP Constructs and methods described herein may elicit an immune response in a subject. The immune response may be an immune response to the epitopes of the antigens in the improved LAMP Construct (e.g., vaccine). Vaccines arm the immune system of the subject such that the immune system may detect and destroy that which contains the antigens of the vaccines in the subject. The improved LAMP Constructs and methods described herein may elicit a Th1 immune response in the subject. Th1 immune responses may include secretion of inflammatory cytokines (e.g., IFNγ, TNFα) by a subset of immune cells (e.g., antigen specific T-cells). In some cases, the inflammatory cytokines activate another subtype of immune cells (e.g., cytotoxic T-cells) which may destroy that which contains the antigen in the subject.

In some cases, the epitopes and/or antigens used in the improved LAMP Constructs and methods described herein may be recognized by the immune system of a subject to elicit a Th1 immune response and release Type I cytokines. The Th1 response may be initiated by the interaction between the epitope and the T-cell, more specifically, the major histocompatibility complex (MHC) expressed by the T-cell. For example, high affinity binding of an epitope to an MHC receptor may stimulate a Th1 response. MHC receptors may be at least one of a plurality of types of MHC receptors. The MHC receptors engaged on a T-cell may vary across individuals in a population.

In some cases, the immune response is a Type 1 immune response. In some cases, the immune response is characterized by a ratio of Type I cytokine production to Type II cytokine production that is greater than 1. In some cases, the immune response is characterized by a ratio of Type I cytokine production to Type II cytokine production that is less than 1. In some cases, the immune response is characterized by a ratio of IFNγ production to IL-10 production that is greater than 1. In some cases, the immune response is characterized by a ratio of IFNγ production to IL-10 production that is less than 1.

Prime boost protocols are also contemplated. For example, the invention further provides a method for generating an immune response in a subject to a cancer antigen, comprising priming the subject with an improved LAMP Construct comprising a cancer antigen as described herein followed by at least one boosting of the subject with the antigen or a related antigen (e.g., a second antigen derived from the same or highly similar protein sequence). Mixtures of antigens can be used in either or both the priming and the boosting step. Use of an improved LAMP Construct for the prime step followed by an antigen boost step has been shown to significantly produce higher titers, indicating the power of LAMP in enhancing antibody response.

It is yet another object of this invention to provide improved methods of treatment for cancer and/or hyperproliferative disorders by eliciting an anti-tumor immune response through stimulation of helper T cells.

The invention further provides a nucleic acid molecule encoding any of the improved LAMP Constructs comprising the cancer antigens described herein. The invention also provides an improved LAMP Construct comprising an antigen to generate antibodies. The improved LAMP Construct can comprise a nucleic acid wherein the nucleic acid molecule is operably linked to an expression control sequence. In one preferred aspect, the improved LAMP Construct is a vaccine vector, suitable for vaccinating a patient. In another aspect, the invention provides a delivery vehicle comprising the improved LAMP Construct for facilitating the introduction of the nucleic acid molecule encoding the antigen into a cell. The delivery vehicle may be lipid-based (e.g., a liposome formulation), viral-based (e.g., comprising viral proteins encapsulating the nucleic acid molecule), or cell-based.

In preferred embodiments, the invention provides an injectable composition comprising an improved LAMP Construct comprising a cancer antigen of interest for eliciting an immune response (e.g., generation of antibodies) in a mammal to the cancer antigen. In preferred embodiments, this vaccine generates a preferential Th1 response to a Th2 response. The improved LAMP Constructs comprise at least one epitope of a cancer antigen as described herein.

The invention also provides a cell comprising any of the improved LAMP Constructs described herein. In one aspect, the cell is an antigen presenting cell. The antigen presenting cell may be a professional antigen presenting cell (e.g., a dendritic cell, macrophage, B cell, and the like) or an engineered antigen presenting cell (e.g., a non-professional antigen presenting cell engineered to express molecules required for antigen presentation, such as MHC class II molecules). The molecules required for antigen presentation may be derived from other cells, e.g., naturally occurring, or may themselves be engineered (e.g. mutated or modified to express desired properties, such as higher or lower affinity for an antigenic epitope). In one aspect, the antigen presenting cell does not express any co-stimulatory signals and the antigen is an auto-antigen.

The invention additionally provides a kit comprising a plurality of cells comprising any of the improved LAMP Constructs described herein. At least two of the cells express different MHC class II molecules, and each cell comprises the same LAMP Construct. In one aspect, a kit is provided comprising an improved LAMP Construct and a cell for receiving the vector.

The invention also provides a transgenic animal comprising at least one of the cells and/or at least one of the improved LAMP Constructs described herein. The invention also provides a transgenic animal comprising at least one of the cells described herein.

The invention further provides a method for generating an immune response in an animal (e.g., a human or a non-human vertebrate) to an antigen, comprising: administering to the animal a cell as described above, wherein the cell expresses, or can be induced to express, the improved LAMP Construct in the animal. In one aspect, the cell comprises an MHC class II molecule compatible with MHC proteins of the animal, such that the animal does not generate an immune response against the MHC class II molecule. In one preferred aspect, the animal is a human.

In one further aspect, the invention provides a method for eliciting an immune response to a cancer antigen, comprising administering to an animal, such as a human or a non-human vertebrate, any of the improved LAMP Constructs described herein. Preferably, the improved LAMP Construct is infectious for a cell of the animal. For example, the improved LAMP Construct may be a viral vector, such as a vaccinia improved LAMP Construct.

For example, the invention further provides a method for generating an immune response in an animal to a cancer antigen, comprising priming the animal with an improved LAMP Construct comprising an antigen as described herein followed by at least one boosting of the animal. Use of an improved LAMP Construct for the prime step followed by an antigen boost step has been shown to significantly produce higher titers, indicating the power of LAMP in enhancing antibody response.

In a further aspect, a cell is obtained from a patient, the improved LAMP Construct described herein is introduced into the cell and the cell or progeny of the cell is reintroduced into the patient. In one aspect, the cell is a stem cell-capable of differentiating into an antigen presenting cell. Treatments of human patients as well as veterinary use are specifically contemplated.

The present invention also comprises methods of generating antibodies in a non-human vertebrate wherein the non-human vertebrate is injected with an improved LAMP Construct comprising an antigen of interest as described herein. The cancer antigen of interest is then efficiently presented to the immune system with the help of LAMP in the non-human vertebrate to raise antibodies against the antigen.

Specifically, by combining presentation of the antigen of interest with LAMP, the antigen is then effectively transported to the cytoplasmic endosomal/lysosomal compartments, where the antigen can be processed and peptides from it presented on the cell surface in association with major histocompatibility (MHC) class II molecules.

These generated antibodies can be isolated from the blood of the vertebrate (as polyclonals) and then further isolated to generate monoclonal antibodies using standard techniques.

In preferred embodiments, the genome of the non-human vertebrate comprises an introduced partially human immunoglobulin region, said introduced region comprising human immunoglobulin variable region locus coding sequences and non-coding sequences based on the endogenous immunoglobulin variable region locus of the non-human vertebrate. Preferably, non-human vertebrate's genome has at least part or all of the endogenous immunoglobulin region removed.

In further preferred embodiments, the production of human monoclonal antibodies in the non-human vertebrate requires that the host have at least one locus that will express human heavy chain immunoglobulin proteins and one locus that will express human light chain immunoglobulin proteins.

In some aspects, the partially human immunoglobulin variable region locus comprises human $V_H$ coding sequences and non-coding $V_H$ sequences based on the endogenous $V_H$ region of the non-human vertebrate. In these aspects, the partially human immunoglobulin variable region locus further comprises human D and J gene coding sequences and non-coding D and J gene sequences based on the endogenous genome of the non-human vertebrate host.

In other aspects, the immunoglobulin region comprises an introduced region comprising human $V_L$ coding sequences and non-coding $V_H$ sequences based on the endogenous $V_L$ region of the non-human vertebrate. More preferably, the introduced partially human immunoglobulin region comprising human $V_L$ coding sequences further comprises human J gene coding sequences and non-coding J gene sequences based on the endogenous genome of the non-human vertebrate host.

In certain aspects, the vertebrate is a mammal, and preferably the mammal is a rodent, e.g., a mouse or rat. In other aspects, the vertebrate is avian, e.g., a chicken. Other non-human vertebrates include rabbits, llamas, camels, a cow, a guinea pig, a hamster, a dog, a cat, a horse, a non-human primate, a simian (e.g. a monkey or ape), a monkey (e.g. marmoset, baboon, rhesus macaque), or an ape (e.g. gorilla, chimpanzee, orangutan, gibbon).

In further embodiments, the partially human immunoglobulin region comprises human $V_H$ gene coding regions, and further comprises i) human D and J gene coding sequences and ii) non-coding D and J gene and pre-DJ sequences based on the endogenous genome of the non-human vertebrate host. In other aspects, the $V_H$ gene coding regions derive (at least partially) from other sources—e.g., they could be rationally or otherwise designed sequences, sequences that are a combination of human and other designed sequences, or sequences from other species, such as nonhuman primates.

In yet another specific aspect, the partially human immunoglobulin region comprises human $V_L$ gene coding regions, and further comprises i) human J gene coding sequences and ii) non-coding J gene sequences based on the endogenous genome of the non-human vertebrate host. In a specific aspect, the partially human immunoglobulin region comprises human $V_H$ coding regions, human D and J gene coding sequences, and non-coding D and J gene and pre-DJ sequences based on the endogenous genome of the non-human vertebrate host.

The methods described herein can be used in the production and/or optimization of antibodies, including fully human antibodies, humanized antibodies, chimeric antibodies, for diagnostic and therapeutic uses. Hybridomas producing such antibodies are also a further object of the invention.

These and other aspects, objects and features are described in more detail below.

BRIEF DESCRIPTION OF THE FIGURES

The objects and features of the invention can be better understood with reference to the following detailed description and accompanying drawings.

FIG. 3 provides alignment of LAMP-1 proteins found in other species as compared to human LAMP-1 (SEQ ID NO:1). The equivalent domains of these other species can be used to generate the improved LAMP Constructs described herein and are readily identifiable by comparing the domains identified for human LAMP-1 in FIG. 2 and FIG. 3 to the alignments shown in FIG. 3.

FIG. 4 provides alignment of LAMP-2 proteins found in other species as compared to human LAMP-2 (SEQ ID NO:2). The equivalent domains of these other species can be used to generate the improved LAMP Constructs described herein and are readily identifiable by comparing the domains identified for human LAMP-2 in FIG. 2 and FIG. 4 to the alignments shown in FIG. 4.

FIG. 5 provides alignment of LAMP-3 proteins found in other species as compared to human LAMP-3 (SEQ ID NO:3). The equivalent domains of these other species can be used to generate the improved LAMP Constructs described herein and are readily identifiable by comparing the domains identified for human LAMP-3 in FIG. 2 and FIG. 5 to the alignments shown in FIG. 5.

FIG. 6 provides alignment of LIMP-2 proteins found in other species as compared to human LIMP-2 (SEQ ID NO:4). The equivalent domains of these other species can be used to generate the improved LAMP Constructs described herein and are readily identifiable by comparing the domains identified for human LIMP-2 in FIG. 2 and FIG. 6 to the alignments shown in FIG. 6.

FIG. 7 provides alignment of LIMBIC proteins found in other species as compared to human LIMBIC (SEQ ID NO:67). The equivalent domains of these other species can be used to generate the improved LAMP Constructs described herein and are readily identifiable by comparing the domains identified for human LIMBIC in FIG. 2 and FIG. 7 to the alignments shown in FIG. 7.

FIG. 8 provides alignment of Endolyn proteins found in other species as compared to human Endolyn (SEQ ID NO:5). The equivalent domains of these other species can be used to generate the improved LAMP Constructs described herein and are readily identifiable by comparing the domains identified for human Endolyn in FIG. 2 and FIG. 8 to the alignments shown in FIG. 8.

FIG. 9 provides alignment of Macrosailin proteins found in other species as compared to human Macrosailin (SEQ ID NO:80). The equivalent domains of these other species can be used to generate the improved LAMP Constructs described herein and are readily identifiable by comparing the domains identified for human Macrosailin in FIG. 2 and FIG. 9 to the alignments shown in FIG. 9.

FIG. 10 provides alignment of LAMP-5 proteins found in other species as compared to human LAMP-5 (SEQ ID NO:93). The equivalent domains of these other species can be used to generate the improved LAMP Constructs described herein and are readily identifiable by comparing the domains identified for human LAMP-5 in FIG. 2 and FIG. 10 to the alignments shown in FIG. 10.

FIG. 11 shows results obtained when mice were immunized with HVEM-LAMP, HVEM, or LAMP on day 0, 7, and 14. On day 28, mice were bled and serum samples were isolated. HVEM specific IgG was examined by ELISA. Data represent geometric mean of antibody titers±geometric SD, n=6. **p value <0.01

FIG. 12 shows results obtained when mice were immunized with HVEM-LAMP, HVEM, or LAMP on day 0, 7, and 14. On day 35, mice were boosted with 5 µg HVEM protein in the presence of alum adjuvant. Mice were bled on day 49 and serum samples were isolated. HVEM specific IgG was examined by ELISA. Data represent geometric mean of antibody titers±geometric SD, n=6. *p value <0.001; **p value <0.0001.

FIG. 13 shows that LAMP alters the binding affinity of epitopes in CRD3/4 of HVEM.

DETAILED DESCRIPTION

Figure 1:
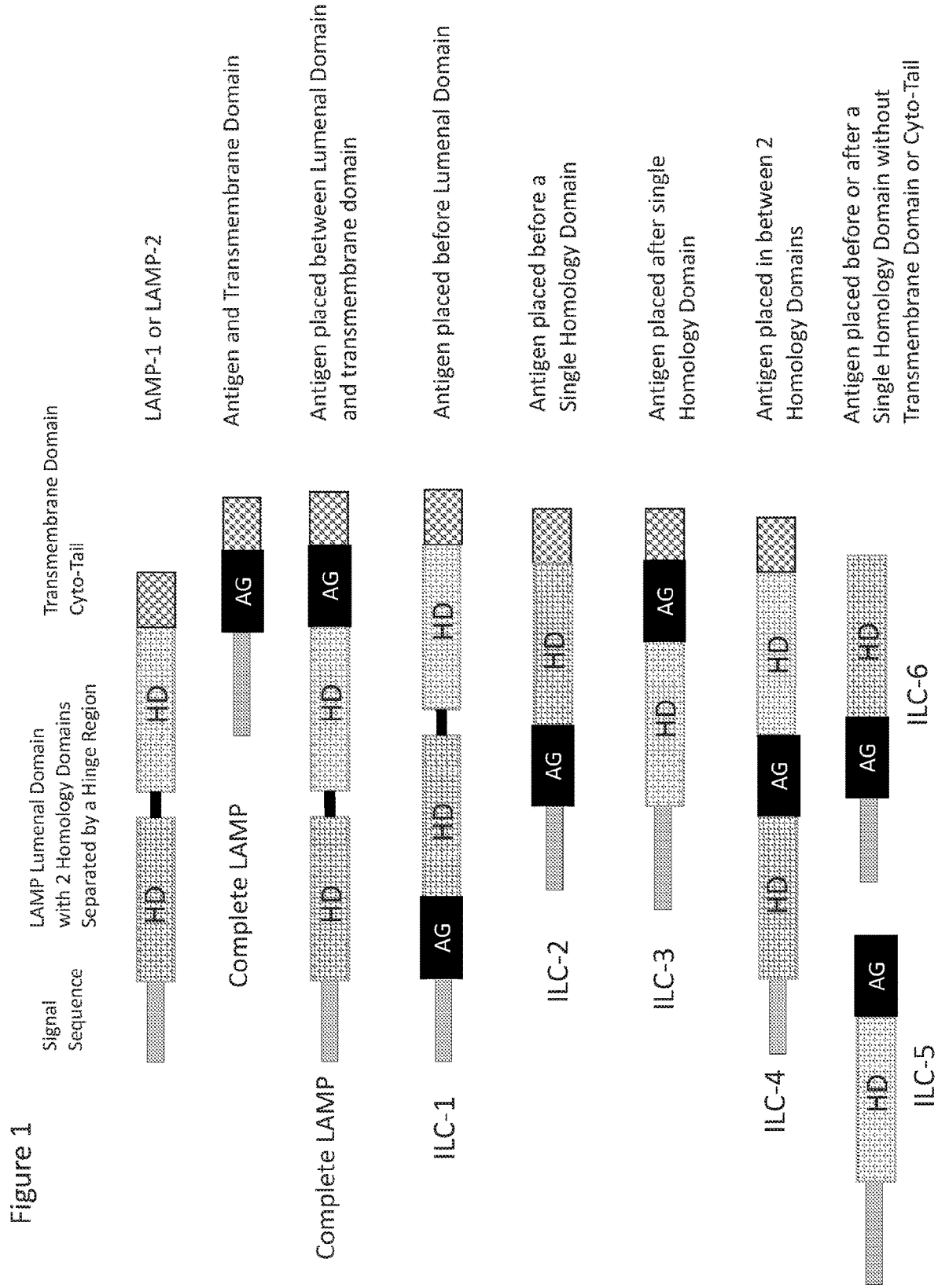
FIG. 1 illustrates the general scheme of different types of improved LAMP Constructs (identified as ILC-1, ILC-2, ILC-3, ILC-4, ILC-5 and ILC-6) that can be used as described herein.

The invention provides improved LAMP Constructs which can be used to generate vaccines and/or used to raise antibodies. The improved LAMP Constructs can be used to modulate or enhance an immune response. In one preferred aspect, the invention provides a method for treating a patient with cancer or a hyperproliferative disorder by providing an improved LAMP Construct comprising one or more of the cancer antigens as described herein. The improved LAMP Constructs can also be used to raise antibodies in non-human vertebrates, and in preferably, non-human mammals.

Definitions

The following definitions are provided for specific terms which are used in the following written description.

As used in the specification and claims, the singular form "a", "an" and "the" include plural references unless the context clearly dictates otherwise. For example, the term "a cell" includes a plurality of cells, including mixtures thereof. The term "a nucleic acid molecule" includes a plurality of nucleic acid molecules.

As used herein, the term "comprising" is intended to mean that the improved LAMP Constructs and methods include the recited elements, but do not exclude other elements. "Consisting essentially of", when used to define improved LAMP Constructs and methods, shall mean excluding other elements of any essential significance to the combination. Thus, an improved LAMP Construct consisting essentially of the elements as defined herein would not exclude trace contaminants from the isolation and purification method and pharmaceutically acceptable carriers, such as phosphate buffered saline, preservatives, and the like. "Consisting of" shall mean excluding more than trace elements of other ingredients and substantial method steps for administering the improved LAMP Constructs of this invention. Embodiments defined by each of these transition terms are within the scope of this invention.

The term "about" or "approximately" means within an acceptable range for the particular value as determined by one of ordinary skill in the art, which will depend in part on how the value is measured or determined, e.g., the limitations of the measurement system. For example, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5 fold, and more preferably within 2 fold, of a value. Unless otherwise stated, the term 'about' means within an acceptable error range for the particular value, such as ±1-20%, preferably ±1-10% and more preferably ±1-5%.

Where a range of values is provided, it is understood that each intervening value, between the upper and lower limit of that range and any other stated or intervening value in that stated range is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either both of those included limits are also included in the invention.

As used herein, "the lysosomal/endosomal compartment" refers to membrane-bound acidic vacuoles containing LAMP molecules in the membrane, hydrolytic enzymes that function in antigen processing, and MHC class II molecules for antigen recognition and presentation. This compartment functions as a site for degradation of foreign materials internalized from the cell surface by any of a variety of mechanisms including endocytosis, phagocytosis and pinocytosis, and of intracellular material delivered to this compartment by specialized autolytic phenomena (de Duve, Eur. J. Biochem. 137: 391, 1983). The term "endosome" as used herein and in the claims encompasses a lysosome.

As used herein, a "lysosome-related organelle" refers to any organelle which comprises lysosymes and includes, but is not limited to, MIIC, CIIV, melanosomes, secretory granules, lytic granules, platelet-dense granules, basophil granules, Birbeck granules, phagolysosomes, secretory lysosomes, and the like. Preferably, such an organelle lacks mannose 6-phosphate receptors and comprises LAMP, but may or may not comprise an MHC class II molecule. For reviews, see, e.g., Blott and Griffiths, Nature Reviews, Molecular Cell Biology, 2002; Dell'Angelica, et al., The FASEB Journal 14: 1265-1278, 2000.

As used herein, the terms "polynucleotide" and "nucleic acid molecule" are used interchangeably to refer to polymeric forms of nucleotides of any length. The polynucleotides may contain deoxyribonucleotides, ribonucleotides, and/or their analogs. Nucleotides may have any three-dimensional structure, and may perform any function, known or unknown. The term "polynucleotide" includes, for example, single-, double-stranded and triple helical molecules, a gene or gene fragment, exons, introns, mRNA, tRNA, rRNA, ribozymes, antisense molecules, cDNA, recombinant polynucleotides, branched polynucleotides, aptamers, plasmids, vectors, isolated DNA of any sequence, isolated RNA of any sequence, nucleic acid probes, and primers. A nucleic acid molecule may also comprise modified nucleic acid molecules (e.g., comprising modified bases, sugars, and/or internucleotide linkers).

As used herein, the term "peptide" refers to a compound of two or more subunit amino acids, amino acid analogs, or peptidomimetics. The subunits may be linked by peptide bonds or by other bonds (e.g., as esters, ethers, and the like).

As used herein, the term "amino acid" refers to either natural and/or unnatural or synthetic amino acids, including glycine and both D or L optical isomers, and amino acid analogs and peptidomimetics. A peptide of three or more amino acids is commonly called an oligopeptide if the peptide chain is short. If the peptide chain is long (e.g., greater than about 10 amino acids), the peptide is commonly called a polypeptide or a protein. While the term "protein" encompasses the term "polypeptide", a "polypeptide" may be a less than full-length protein.

As used herein a "LAMP polypeptide" refers to the mammalian lysosomal associated membrane proteins human LAMP-1, human LAMP-2, human LAMP-3, human LIMP-2, human Endolyn, human LIMBIC, human LAMP-5, or human Macrosailin as described herein, as well as orthologs (such as, for example, the LAMP proteins shown in FIGS. 3-10), and allelic variants.

As used herein, "expression" refers to the process by which polynucleotides are transcribed into mRNA and/or translated into peptides, polypeptides, or proteins. If the polynucleotide is derived from genomic DNA, expression may include splicing of the mRNA transcribed from the genomic DNA.

As used herein, "under transcriptional control" or "operably linked" refers to expression (e.g., transcription or translation) of a polynucleotide sequence which is controlled by an appropriate juxtaposition of an expression control element and a coding sequence. In one aspect, a DNA sequence is "operatively linked" to an expression control sequence when the expression control sequence controls and regulates the transcription of that DNA sequence.

As used herein, "coding sequence" is a sequence which is transcribed and translated into a polypeptide when placed under the control of appropriate expression control sequences. The boundaries of a coding sequence are determined by a start codon at the 5' (amino) terminus and a translation stop codon at the 3' (carboxyl) terminus. A coding sequence can include, but is not limited to, a prokaryotic sequence, cDNA from eukaryotic mRNA, a genomic DNA sequence from eukaryotic (e.g., mammalian) DNA, and even synthetic DNA sequences. A polyadenylation signal and transcription termination sequence will usually be located 3' to the coding sequence.

As used herein, two coding sequences "correspond" to each other if the sequences or their complementary sequences encode the same amino acid sequences.

As used herein, "signal sequence" denotes the endoplasmic reticulum translocation sequence. This sequence encodes a signal peptide that communicates to a cell to direct a polypeptide to which it is linked (e.g., via a chemical bond) to an endoplasmic reticulum vesicular compartment, to enter an exocytic/endocytic organelle, to be delivered either to a cellular vesicular compartment, the cell surface or to secrete the polypeptide. This signal sequence is sometimes clipped off by the cell in the maturation of a protein. Signal sequences can be found associated with a variety of proteins native to prokaryotes and eukaryotes.

As used herein, "trafficking" denotes movement or progression of the polypeptide encoded by the improved LAMP Construct through cellular organelles or compartments in the pathway from the rough endoplasmic reticulum to the endosomal/lysosomal compartment or related organelles where antigen processing and binding to MHC II occurs.

As used herein, an "improved LAMP Construct" and an "improved LAMP Construct comprising an antigen" and an "improved LAMP Construct comprising an antigen of interest" are used interchangeably. The different arrangements of the improved LAMP Constructs are illustrated in FIG. 1 as ILC1-ILC6. Moreover, the use of an "improved LAMP Construct" encompasses both the polynucleotide sequence of the improved LAMP Construct as well as the protein encoded by the polynucleotide sequence of the improved LAMP Construct.

As used herein, an "improved LAMP Construct delivery vehicle" is defined as any molecule or group of molecules or macromolecules that can carry an improved LAMP Construct into a host cell (e.g., such as genes or gene fragments, antisense molecules, ribozymes, aptamers, and the like) and which occurs in association with an improved LAMP Construct as described herein.

As used herein, "improved LAMP Construct delivery," or "improved LAMP Construct transfer," refers to the introduction of the improved LAMP Construct into a host cell, irrespective of the method used for the introduction. The introduced improved LAMP Constructs may be stably or transiently maintained in the host cell. Stable maintenance typically requires that the introduced improved LAMP Construct either contains an origin of replication compatible with the host cell or integrates into a replicon of the host cell such as an extrachromosomal replicon (e.g., a plasmid) or a nuclear or mitochondrial chromosome.

As used herein, a "viral improved LAMP Construct" refers to a virus or viral particle that comprises the improved LAMP Construct to be delivered into a host cell, either in vivo, ex vivo or in vitro. Examples of viral improved LAMP Constructs include, but are not limited to, adenovirus vectors, adeno-associated virus vectors, retroviral vectors, and the like. In aspects where gene transfer is mediated by an adenoviral vector, an improved LAMP Construct includes the adenovirus genome or part thereof, and a selected, non-adenoviral gene, in association with adenoviral capsid proteins.

As used herein, "adenoviral-mediated gene transfer" or "adenoviral transduction" refers to the process by which an improved LAMP Construct is transferred into a host cell by virtue of the adenovirus entering the cell. Preferably, the improved LAMP Construct is able to replicate and/or integrate and be transcribed within the cell.

As used herein, "adenovirus particles" are individual adenovirus virions comprised of an external capsid and an improved LAMP Construct, where the capsid is further comprised of adenovirus envelope proteins. The adenovirus envelope proteins may be modified to comprise a fusion polypeptide which contains a polypeptide ligand covalently attached to the viral protein, e.g., for targeting the adenoviral particle to a particular cell and/or tissue type.

As used herein, the term "administering" or "immunizing" or "injecting" an improved LAMP Construct refers to transducing, transfecting, microinjecting, electroporating, or shooting the cell with the improved LAMP Construct. In some aspects, improved LAMP Constructs are introduced into a target cell by contacting the target cell with a delivery cell (e.g., by cell fusion or by lysing the delivery cell when it is in proximity to the target cell).

As used herein, the phrase "prime boost" describes the use of an improved LAMP Construct described herein used to prime a T-cell response followed by the use of a second improved LAMP Construct comprising an antigen, a DNA vaccine comprising an antigen or a recombinant antigen to boost the response (or visa versa). These heterologous prime-boost immunizations elicit immune responses of greater height and breadth than can be achieved by priming and boosting with the same vector. The priming with an improved LAMP Construct comprising an antigen initiates memory cells; the boost step expands the memory response. Preferably, two different agents that do not raise responses against each other are used and thus do not interfere with each other's activity. Mixtures of antigens are specifically contemplated in the prime and/or boost step. Boosting can occur once or multiple times.

As used herein, "hybridization" refers to a reaction in which one or more polynucleotides react to form a complex that is stabilized via hydrogen bonding between the bases of the nucleotide residues. The hydrogen bonding may occur by Watson-Crick base pairing, Hoogstein binding, or in any other sequence-specific manner. The complex may comprise two strands forming a duplex structure, three or more strands forming a multi-stranded complex, a single self-hybridizing strand, or any combination of these. A hybridization reaction may constitute a step in a more extensive process, such as the initiation of a PCR reaction, or the enzymatic cleavage of a polynucleotide by a ribozyme.

As used herein, a polynucleotide or polynucleotide region (or a polypeptide or polypeptide region) which has a certain percentage (for example, at least about 50%, at least about 60%, at least about 70%, at least about 80%, at least about 85%, at least about 90%, at least about 95%, at least about 99%) of "sequence identity" to another sequence means that, when maximally aligned, using software programs routine in the art, that percentage of bases (or amino acids) are the same in comparing the two sequences.

Two sequences are "substantially homologous" or "substantially similar" when at least about 50%, at least about 60%, at least about 70%, at least about 75%, and preferably at least about 80%, and most preferably at least about 90 or 95% of the nucleotides match over the defined length of the DNA sequences. Similarly, two polypeptide sequences are "substantially homologous" or "substantially similar" when at least about 50%, at least about 60%, at least about 66%, at least about 70%, at least about 75%, and preferably at least about 80%, and most preferably at least about 90 or 95% of the amino acid residues of the polypeptide match over a defined length of the polypeptide sequence. Sequences that are substantially homologous can be identified by comparing the sequences using standard software available in sequence data banks. Substantially homologous nucleic acid sequences also can be identified in a Southern hybridization experiment under, for example, stringent conditions as defined for that particular system. Defining appropriate hybridization conditions is within the skill of the art. For example, stringent conditions can be: hybridization at 5×SSC and 50% formamide at 42° C., and washing at 0.1×SSC and 0.1% sodium dodecyl sulfate at 60° C. Further examples of stringent hybridization conditions include: incubation temperatures of about 25 degrees C. to about 37 degrees C.; hybridization buffer concentrations of about 6×SSC to about 10×SSC; formamide concentrations of about 0% to about 25%; and wash solutions of about 6×SSC. Examples of moderate hybridization conditions include: incubation temperatures of about 40 degrees C. to about 50 degrees C.; buffer concentrations of about 9×SSC to about 2×SSC; formamide concentrations of about 30% to about 50%; and wash solutions of about 5×SSC to about 2×SSC. Examples of high stringency conditions include: incubation temperatures of about 55 degrees C. to about 68 degrees C.; buffer concentrations of about 1×SSC to about 0.1×SSC; formamide concentrations of about 55% to about 75%; and wash solutions of about 1×SSC, 0.1×SSC, or deionized water. In general, hybridization incubation times are from 5 minutes to 24 hours, with 1, 2, or more washing steps, and wash incubation times are about 1, 2, or 15 minutes. SSC is 0.15 M NaCl and 15 mM citrate buffer. It is understood that equivalents of SSC using other buffer systems can be employed. Similarity can be verified by sequencing, but preferably, is also or alternatively, verified by function (e.g., ability to traffic to an endosomal compartment, and the like), using assays suitable for the particular domain in question.

The terms "percent (%) sequence similarity", "percent (%) sequence identity", and the like, generally refer to the degree of identity or correspondence between different nucleotide sequences of nucleic acid molecules or amino acid sequences of polypeptides that may or may not share a common evolutionary origin (see Reeck et al., supra). Sequence identity can be determined using any of a number of publicly available sequence comparison algorithms, such as BLAST, FASTA, DNA Strider, GCG (Genetics Computer Group, Program Manual for the GCG Package, Version 7, Madison, Wisconsin), etc.

To determine the percent identity between two amino acid sequences or two nucleic acid molecules, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are, or are about, of the same length. The percent identity between two sequences can be determined using techniques similar to those described below, with or without allowing gaps. In calculating percent sequence identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, Proc. Natl. Acad. Sci. USA 1990, 87:2264, modified as in Karlin and Altschul, Proc. Natl. Acad. Sci. USA 1993, 90:5873-5877. Such an algorithm is incorporated into the NBLAST and XBLAST programs of Altschul et al, J. Mol. Biol. 1990; 215:403. BLAST nucleotide searches can be performed with the NBLAST program, score=100, wordlength=12, to obtain nucleotide sequences homologous to sequences of the invention. BLAST protein searches can be performed with the XBLAST program, score=50, wordlength=3, to obtain amino acid sequences homologous to protein sequences of the invention. To obtain gapped alignments for comparison purposes, Gapped BLAST can be utilized as described in Altschul et al, Nucleic Acids Res. 1997, 25:3389. Alternatively, PSI-Blast can be used to perform an iterated search that detects distant relationship between molecules. See Altschul et al. (1997) supra. When utilizing BLAST, Gapped BLAST, and PSI-Blast programs, the default parameters of the respective programs (e.g., XBLAST and NBLAST) can be used. See ncbi.nlm.nih.gov/BLAST/on the WorldWideWeb.

Another non-limiting example of a mathematical algorithm utilized for the comparison of sequences is the algorithm of Myers and Miller, CABIOS 1988; 4: 11-17. Such an algorithm is incorporated into the ALIGN program (version 2.0), which is part of the GCG sequence alignment software package. When utilizing the ALIGN program for comparing amino acid sequences, a PAM120 weight residue table, a gap length penalty of 12, and a gap penalty of 4 can be used.

In a preferred embodiment, the percent identity between two amino acid sequences is determined using the algorithm of Needleman and Wunsch (J. Mol. Biol. 1970, 48:444-453), which has been incorporated into the GAP program in the GCG software package (Accelrys, Burlington, MA; available at accelrys.com on the WorldWideWeb), using either a Blossum 62 matrix or a PAM250 matrix, a gap weight of 16, 14, 12, 10, 8, 6, or 4, and a length weight of 1, 2, 3, 4, 5, or 6. In yet another preferred embodiment, the percent identity between two nucleotide sequences is determined using the GAP program in the GCG software package using a NWSgapdna.CMP matrix, a gap weight of 40, 50, 60, 70, or 80, and a length weight of 1, 2, 3, 4, 5, or 6. A particularly preferred set of parameters (and the one that can be used if the practitioner is uncertain about what parameters should be applied to determine if a molecule is a sequence identity or homology limitation of the invention) is using a Blossum 62 scoring matrix with a gap open penalty of 12, a gap extend penalty of 4, and a frameshift gap penalty of 5.

Another non-limiting example of how percent identity can be determined is by using software programs such as those described in Current Protocols In Molecular Biology (F. M. Ausubel et al., eds., 1987) Supplement 30, section 7.7.18, Table 7.7.1. Preferably, default parameters are used for alignment. A preferred alignment program is BLAST, using default parameters. In particular, preferred programs are BLASTN and BLASTP, using the following default parameters: Genetic code=standard; filter=none; strand=both; cut-off=60; expect=10; Matrix=BLOSUM62; Descriptions=50 sequences; sort by=HIGH SCORE; Databases=non-redundant, GenBank+EMBL+DDBJ+PDB+GenBank CDS translations: SwissProtein+SPupdate+PIR. Details of these programs can be found at the following Internet address: http://www.ncbi.nlm.nih.gov/cgi-bin/BLAST.

Statistical analysis of the properties described herein may be carried out by standard tests, for example, t-tests, ANOVA, or Chi squared tests. Typically, statistical significance will be measured to a level of p=0.05 (5%), more preferably p=0.01, p=0.001, p=0.0001, p=0.000001

"Conservatively modified variants" of domain sequences also can be provided. With respect to particular nucleic acid sequences, conservatively modified variants refer to those nucleic acids which encode identical or essentially identical amino acid sequences, or where the nucleic acid does not encode an amino acid sequence, to essentially identical sequences. Specifically, degenerate codon substitutions can be achieved by generating sequences in which the third position of one or more selected (or all) codons is substituted with mixed-base and/or deoxyinosine residues (Batzer, et al., 1991, Nucleic Acid Res. 19: 5081; Ohtsuka, et al., 1985, J. Biol. Chem. 260: 2605-2608; Rossolini et al., 1994, Mol. Cell. Probes 8: 91-98).

The term "biologically active fragment", "biologically active form", "biologically active equivalent" of and "functional derivative" of a wild-type protein, possesses a biological activity that is at least substantially equal (e.g., not significantly different from) the biological activity of the wild type protein as measured using an assay suitable for detecting the activity.

As used herein, "in vivo" nucleic acid delivery, nucleic acid transfer, nucleic acid therapy" and the like, refer to the introduction of an improved LAMP Construct directly into the body of an organism, such as a human or non-human mammal, whereby the improved LAMP Construct is introduced to a cell of such organism in vivo.

As used herein, the term "in situ" refers to a type of in vivo nucleic acid delivery in which the improved LAMP Construct is brought into proximity with a target cell (e.g., the nucleic acid is not administered systemically). For example, in situ delivery methods include, but are not limited to, injecting an improved LAMP Construct directly at a site (e.g., into a tissue, such as a tumor or heart muscle), contacting the improved LAMP Construct with cell(s) or tissue through an open surgical field, or delivering the improved LAMP Constructs to a site using a medical access device such as a catheter.

As used herein, the term "isolated" or "purified" means separated (or substantially free) from constituents, cellular and otherwise, in which the polynucleotide, peptide, polypeptide, protein, antibody, or fragments thereof, are normally associated with in nature. For example, with respect to an improved LAMP Construct, an isolated polynucleotide is one that is separated from the 5' and 3' sequences with which it is normally associated in the chromosome. As is apparent to those of skill in the art, a non-naturally occurring polynucleotide, peptide, polypeptide, protein, antibody, or fragments thereof, does not require "isolation" to distinguish it from its naturally occurring counterpart. By substantially free or substantially purified, it is meant at least 50% of the population, preferably at least 70%, more preferably at least 80%, and even more preferably at least 90%, are free of the components with which they are associated in nature.

As used herein, a "target cell" or "recipient cell" refers to an individual cell or cell which is desired to be, or has been, a recipient of the improved LAMP Constructs described herein. The term is also intended to include progeny of a single cell, and the progeny may not necessarily be completely identical (in morphology or in genomic or total DNA complement) to the original parent cell due to natural, accidental, or deliberate mutation. A target cell may be in contact with other cells (e.g., as in a tissue) or may be found circulating within the body of an organism.

As used herein, a "subject" is a vertebrate, preferably a mammal, more preferably a human. Mammals include, but are not limited to, murines, simians, humans, farm animals, sport animals, and pets. In other preferred embodiments, the "subject" is a rodent (e.g. a rat, a mouse, a rabbit, a llama, camels, a cow, a guinea pig, a hamster, a dog, a cat, a horse, a non-human primate, a simian (e.g. a monkey or ape), a monkey (e.g. marmoset, baboon, rhesus macaque), or an ape (e.g. gorilla, chimpanzee, orangutan, gibbon). In other embodiments, non-human mammals, especially mammals that are conventionally used as models for demonstrating therapeutic efficacy in humans (e.g. murine, primate, porcine, canine, or rabbit animals) may be employed.

The terms "cancer," "neoplasm," and "tumor," are used interchangeably and in either the singular or plural form, refer to cells that have undergone a malignant transformation that makes them pathological to the host organism. Primary cancer cells transformation that makes them pathological to the host organism. Primary cancer cells (that is, cells obtained from near the site of malignant transformation) can be readily distinguished from non-cancerous cells by well-established techniques, particularly histological examination. The definition of a cancer cell, as used herein, includes not only a primary cancer cell, but any cell derived from a cancer cell ancestor. This includes metastasized cancer cells, and in vitro cultures and cell lines derived from cancer cells. When referring to a type of cancer that normally manifests as a solid tumor, a "clinically detectable" tumor is one that is detectable on the basis of tumor mass, e.g., by procedures such as CAT scan, MR imaging, X-ray, ultrasound or palpation, and/or which is detectable because of the expression of one or more cancer-specific antigens in a sample obtainable from a patient.

In preferred embodiments, the cancer (including all stages of progression, including hyperplasia) is an adenocarcinoma, sarcoma, skin cancer, melanoma, bladder cancer, brain cancer (including glioblastoma multiforme), breast cancer, uterine cancer, ovarian cancer, prostate cancer, lung cancer (including, but not limited to NSCLC, SCLC, squamous cell cancer), colorectal cancer, anal cancer, rectal cancer, cervical cancer, liver cancer, head and neck cancer, oral cancer, salivary gland cancer, esophageal cancer, pancreas cancer, pancreatic ductal adenocarcinoma (PDA), renal cancer, stomach cancer, kidney cancer, multiple myeloma or cerebral cancer. Also, preferred diseases to be treated with the LAMP Constructs described herein include those hyperproliferative disorders or cancer caused by cytomegalovirus (CMV).

As used herein, the term "pharmaceutically acceptable carrier" encompasses any of the standard pharmaceutical carriers, such as a phosphate buffered saline solution, water, and emulsions, such as an oil/water or water/oil emulsion, and various types of wetting agents. Compositions comprising the improved LAMP Constructs also can include stabilizers and preservatives. For examples of carriers, stabilizers and adjuvants, see Martin Remington's Pharm. Sci., 15th Ed. (Mack Publ. Co., Easton (1975)).

A cell has been "transformed", "transduced", or "transfected" by the improved LAMP Constructs when such nucleic acids have been introduced inside the cell. Transforming DNA may or may not be integrated (covalently linked) with chromosomal DNA making up the genome of the cell. In prokaryotes, yeast, and mammalian cells for example, the improved LAMP Constructs may be maintained on an episomal element, such as a plasmid. In a eukaryotic cell, a stably transformed cell is one in which the improved LAMP Constructs have become integrated into a chromosome so that it is inherited by daughter cells through chromosome replication. This stability is demonstrated by the ability of the eukaryotic cell to establish cell lines or clones comprised of a population of daughter cells containing the improved LAMP Constructs. A "clone" is a population of cells derived from a single cell or common ancestor by mitosis. A "cell line" is a clone of a primary cell that is capable of stable growth in vitro for many generations (e.g., at least about 10).

As used herein, an "effective amount" is an amount sufficient to affect beneficial or desired results, e.g., such as an effective amount of the improved LAMP Construct transfer and/or expression, and/or the attainment of a desired therapeutic endpoint. An effective amount can be administered in one or more administrations, applications or dosages. In one aspect, an effective amount of an improved LAMP Construct is an amount sufficient to transform/transduce/transfect at least one cell in a population of cells comprising at least two cells.

As used herein, a "therapeutically effective amount" is used herein to mean an amount sufficient to prevent, correct and/or normalize an abnormal physiological response. In one aspect, a "therapeutically effective amount" is an amount sufficient to reduce by at least about 30 percent, more preferably by at least 50 percent, most preferably by at least 90 percent, a clinically significant feature of pathology, such as for example, size of a tumor mass, antibody production, cytokine production, fever or white cell count, etc.

An "antibody" is any immunoglobulin, including antibodies and fragments thereof, that binds a specific antigen. The term encompasses polyclonal, monoclonal, and chimeric antibodies (e.g., bispecific antibodies). An "antibody combining site" is that structural portion of an antibody molecule comprised of heavy and light chain variable and hypervariable regions that specifically binds antigen. Exemplary antibody molecules are intact immunoglobulin molecules, substantially intact immunoglobulin molecules, and those portions of an immunoglobulin molecule that contains the paratope, including Fab, Fab', F(ab')$_2$ and F(v) portions, which portions are preferred for use in the therapeutic methods described herein. Thus, the term antibody encompasses not only whole antibody molecules, but also antibody fragments as well as variants (including derivatives such as fusion proteins) of antibodies and antibody fragments. Examples of molecules which are described by the term "antibody" in this application include, but are not limited to: single chain Fvs (scFvs), Fab fragments, Fab' fragments, F(ab')$_2$, disulfide linked Fvs (sdFvs), Fvs, and fragments comprising or alternatively consisting of, either a VL or a VH domain. The term "single chain Fv" or "scFv" as used herein refers to a polypeptide comprising a VL domain of an antibody linked to a VH domain of an antibody. See Carter (2006) Nature Rev. Immunol. 6:243.

Additionally, antibodies of the invention include, but are not limited to, monoclonal, multi-specific, bi-specific, human, humanized, mouse, or chimeric antibodies, single chain antibodies, camelid antibodies, Fab fragments, F(ab') fragments, anti-idiotypic (anti-Id) antibodies (including, e.g., anti-Id antibodies to antibodies of the invention), domain antibodies and epitope-binding fragments of any of the above. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule.

Most preferably, the antibodies are human antibodies. As used herein, "human" antibodies include antibodies having the amino acid sequence of a human immunoglobulin and include antibodies isolated from human immunoglobulin libraries and xenomice or other organisms that have been genetically engineered to produce human antibodies. The improved LAMP Constructs described herein can be used in combination with known techniques for generating human antibodies and human monoclonal antibodies as described in the exemplified protocols, see, e.g., PCT publications WO 98/24893; WO 92/01047; WO 96/34096; WO 96/33735; European Patent No. 0598877; U.S. Pat. Nos. 5,413,923; 5,625,126; 5,633,425; 5,569,825; 5,661,016; 5,545,806; 5,814,318; 5,885,793; 5,916,771; and 5,939,598; and Lonberg and Huszar, Int. Rev. Immunol. 13:65-93 (1995).

Human antibodies or "humanized" chimeric monoclonal antibodies can be produced using the improved LAMP Constructs in combination with techniques described herein or otherwise known in the art. For example, standard methods for producing chimeric antibodies are known in the art. See, for review the following references: Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).

The antibodies of the present invention may be monovalent, bivalent, trivalent or multivalent. For example, monovalent scFvs can be multimerized either chemically or by association with another protein or substance. A scFv that is fused to a hexahistidine tag or a Flag tag can be multimerized using Ni-NTA agarose (Qiagen) or using anti-Flag antibodies (Stratagene, Inc.). Additionally, the improved LAMP Constructs can be used to generate monospecific, bispecific, trispecific or of greater multispecificity for the encoded antigen(s) contained in the improved LAMP Construct. See, e.g., PCT publications WO 93/17715; WO 92/08802; WO 91/00360; WO 92/05793; Tutt, et al., J. Immunol. 147:60-69 (1991); U.S. Pat. Nos. 4,474,893; 4,714,681; 4,925,648; 5,573,920; 5,601,819; Kostelny et.al., J. Immunol. 148:1547-1553 (1992).

An "epitope" is a structure, usually made up of a short peptide sequence or oligosaccharide, that is specifically recognized or specifically bound by a component of the immune system. T-cell epitopes have generally been shown to be linear oligopeptides. Two epitopes correspond to each other if they can be specifically bound by the same antibody. Two epitopes correspond to each other if both are capable of binding to the same B cell receptor or to the same T cell receptor, and binding of one antibody to its epitope substantially prevents binding by the other epitope (e.g., less than about 30%, preferably, less than about 20%, and more preferably, less than about 10%, 5%, 1%, or about 0.1% of the other epitope binds). In the present invention, multiple epitopes can make up an antigen.

The term "antigen" or "antigen of interest" as used herein covers any polypeptide sequence encoded by a polynucleotide sequence cloned into the improved LAMP Construct which is used to elicit an innate or adaptive immune response as shown in Table 1. An "antigen" encompasses both a single antigen as well as multiple antigenic sequences (derived from the same or different proteins) cloned into the improved LAMP Construct.

The term "antigen presenting cell" as used herein includes any cell which presents on its surface an antigen in association with a major histocompatibility complex molecule, or portion thereof, or, alternatively, one or more non-classical MHC molecules, or a portion thereof. Examples of suitable APCs are discussed in detail below and include, but are not limited to, whole cells such as macrophages, dendritic cells, B cells, hybrid APCs, and foster antigen presenting cells.

As used herein an "engineered antigen-presenting cell" refers to an antigen-presenting cell that has a non-natural molecular moiety on its surface. For example, such a cell may not naturally have a costimulator on its surface or may have an additional artificial costimulator in addition to a natural costimulator on its surface, or may express a non-natural class II molecule on its surface. In preferred embodiments, the engineered antigen-presenting cell has the antigen expressed from the improved LAMP Construct on its surface.

As used herein, "immune effector cells" refers to cells capable of binding an antigen and which mediate an immune response. These cells include, but are not limited to, T cells, B cells, monocytes, macrophages, NK cells and cytotoxic T lymphocytes (CTLs), for example CTL lines, CTL clones, and CTLs from tumor, inflammatory, or other infiltrates.

As used herein, "partially human" refers to a nucleic acid having sequences from both a human and a non-human vertebrate. In the context of partially human sequences, the partially human nucleic acids have sequences of human immunoglobulin coding regions and sequences based on the non-coding sequences of the endogenous immunoglobulin region of the non-human vertebrate. The term "based on" when used with reference to endogenous non-coding sequences from a non-human vertebrate refers to sequences that correspond to the non-coding sequence and share a relatively high degree of homology with the non-coding sequences of the endogenous loci of the host vertebrate, e.g., the non-human vertebrate from which the ES cell is derived. Preferably, the non-coding sequences share at least an 80%, more preferably 90% homology with the corresponding non-coding sequences found in the endogenous loci of the non-human vertebrate host cell into which a partially human molecule comprising the non-coding sequences has been introduced.

The term "immunoglobulin variable region" as used herein refers to a nucleotide sequence that encodes all or a portion of a variable region of an antibody molecule or all or a portion of a regulatory nucleotide sequence that controls expression of an antibody molecule. Immunoglobulin regions for heavy chains may include but are not limited to all or a portion of the V, D, J, and switch regions, including introns. Immunoglobulin region for light chains may include but are not limited to the V and J regions, their upstream flanking sequences, introns, associated with or adjacent to the light chain constant region gene.

By "transgenic animal" is meant a non-human animal, usually a mammal, having an exogenous nucleic acid sequence present as an extrachromosomal element in a portion of its cells or stably integrated into its germ line DNA (i.e., in the genomic sequence of most or all of its cells). In generating a transgenic animal comprising human sequences, a partially human nucleic acid is introduced into the germ line of such transgenic animals by genetic manipulation of, for example, embryos or embryonic stem cells of the host animal according to methods well known in the art.

A "vector" includes plasmids and viruses and any DNA or RNA molecule, whether self-replicating or not, which can be used to transform or transfect a cell.

An "isolated" or "purified" population of cells is substantially free of cells and materials with which it is associated in nature. By substantially free or substantially purified APCs it is meant at least 50% of the population are APCs, preferably at least 70%, more preferably at least 80%, and even more preferably at least 90%, are free of non-APCs cells with which they are associated in nature.

As used herein, a "genetic modification" refers to any addition, deletion or disruption to a cell's normal nucleotides. Any method which can achieve the genetic modification of APCs are within the spirit and scope of this invention. Art recognized methods include viral mediated gene transfer, liposome mediated transfer, transformation, transfection and transduction, e.g., viral-mediated gene transfer such as the use of the improved LAMP Constructs based on DNA viruses such as adenovirus, adeno-associated virus and herpes virus, as well as retroviral based vectors.

The practice of the present invention employs, unless otherwise indicated, conventional molecular biology, microbiology, and recombinant DNA techniques within the skill of the art. Such techniques are explained fully in the literature. Sec, e.g., Maniatis, Fritsch & Sambrook, In Molecular Cloning: A Laboratory Manual (1982); DNA Cloning: A Practical Approach, Volumes I and II (D. N. Glover, ed., 1985); Oligonucleotide Synthesis (M. J. Gait, ed., 1984); Nucleic Acid Hybridization (B. D. Hames & S. J. Higgins, eds., 1985); Transcription and Translation (B. D. Hames & S. I. Higgins, eds., 1984); Animal Cell Culture (R. I. Freshney, ed., 1986); Immobilized Cells and Enzymes (IRL Press, 1986); B. Perbal, A Practical Guide to Molecular Cloning (1984).

Figure 2B:
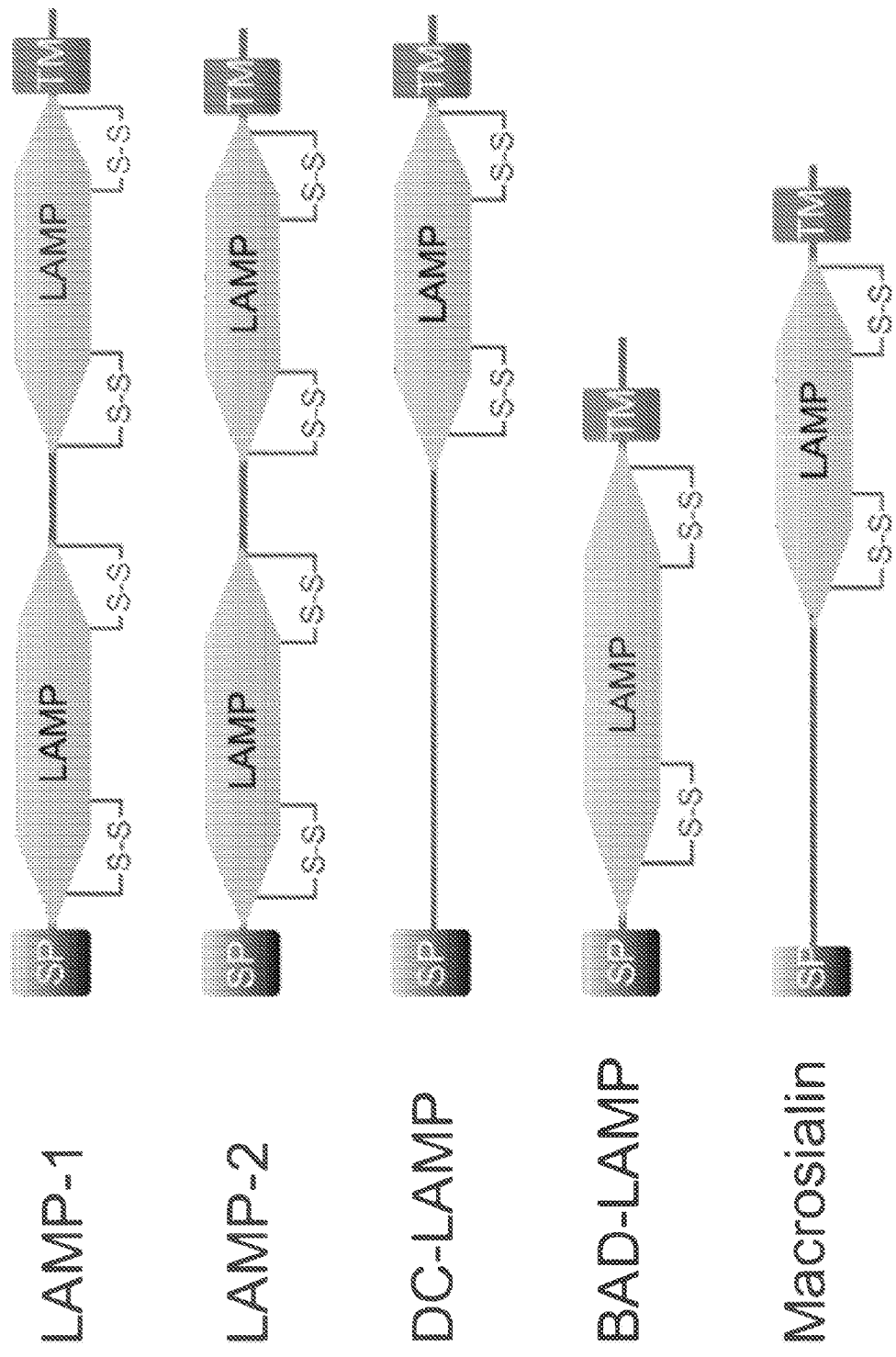
FIG. 2B illustrates the domains of the LAMP proteins defined herein while FIG. 2A defines the specific amino acid boundaries of these domains for human LAMP-1 (SEQ ID NO:1), human LAMP-2 (SEQ ID NO: 2), human LAMP-3 (SEQ ID NO:3), human LIMP-2 (SEQ ID NO:4), human Endolyn (SEQ ID NO:5), human Macrosailin (SEQ ID NO:80), human LAMP-5 (SEQ ID NO:93) and human LIMBIC (SEQ ID NO:67). As described herein the LAMP lumenal domains, homology domains, transmembrane domains, the cytoplasmic tail and the signal sequences can be used to generate the improved LAMP Constructs ILC-1, ILC-2, ILC-3, ILC-4, ILC-5 and ILC-6 as described herein.

Unless defined otherwise, all technical and scientific terms used herein have the same meaning as commonly understood by one of ordinary skill in the art to which this invention belongs. All publications mentioned herein are incorporated by reference for the purpose of describing and disclosing devices, formulations and methodologies that may be used in connection with the presently described invention LAMP Constructs LAMP-1, as deduced from a cDNA clone (Chen, et al., J. Biol. Chem. 263: 8754, 1988) consists of a polypeptide core of about 382 amino acids with a large (346-residue) lumenal amino-terminal domain followed by a 24-residue hydrophobic transmembrane region and short (12-residue) carboxyl-terminal cytoplasmic tail. See, FIGS. 2A and 2B. The lumenal domain is highly glycosylated, being substituted with about 20 asparagine linked complex-type oligosaccharides and consists of two approximately 160-residue "homology domains" that are separated by a proline/serine-rich hinge region. Each of these "homology domains" contains 4 uniformly spaced cysteine residues, disulfide bonded to form four 36-38-residue loops symmetrically placed within the two halves of the lumenal domain (Arterburn, et al., J. Biol. Chem. 265: 7419, 1990; see, also Chen, et al., J. Biol. Chem. 25: 263(18): 8754-8, 1988). FIG. 2A schematically shows the conserved domains between LAMP-1, LAMP-2, LAMP-3, Endolyn, LIMBIC, LAMP5, or Macrosailin.

Previously reported LAMP constructs comprise the following elements in this specific arrangement: (a) a full lumenal domain of LAMP-1 protein, the antigen and then the full transmembrane/cytoplasmic tail of LAMP-1 protein; or (b) the antigen and the full transmembrane/cytoplasmic tail of a LAMP-1 protein. In example (a), the antigenic sequence is inserted in between the full lumenal domain of a LAMP-1 protein and the LAMP-1 full transmembrane domain/cytoplasmic tail. Both constructs have been shown to successfully target an antigenic sequence to the lysosome/endosome and will be referred to as "complete LAMP Constructs" as shown in FIG. 1 as compared to the improved LAMP Constructs ILC1-ILC6 described herein. The improved LAMP Constructs described herein do not include the complete LAMP Constructs described in the prior art.

Although it has been widely reported in the literature that fragments smaller than the full lumenal domain of LAMP-1 were not effective in generating a robust immune response (see, e.g. Godinho et al.). In contrast, the inventors unexpectedly discovered that specific fragments, in certain arrangements, did in fact effectively present antigens to the immune system, generating in many cases a more robust immune response, including the generation of a different repertoire of antibodies. For example, the inventors have identified that the minimal LAMP lumenal domain fragment that is effective for generating a robust immune response is not the full lumenal domain (as widely reported in the literature) but rather a single Homology Domain of the Lumenal Domain of a LAMP Protein.

For example, constructs can comprise, not the full lumenal domain, but instead a single Homology Domain of the Lumenal Domain of a LAMP Protein. As used herein, the "Homology Domain" comprises at least the 4 uniformly spaced cysteine residues shown in FIGS. 3-10. These cysteine resides are labeled 1, 2, 3, and 4 (and in LIMP-2 and Macrosailin-five cysteines are identified, LIMBIC-six cysteines are identified and Endolyn-eight cysteines are identified) in each Homology Domain as shown in FIGS. 3-10 and are defined herein as the "Cysteine Conserved Fragment." Additional amino acids can be included to either the N-terminus end and/or the C-terminus end of the Cysteine Conserved Fragment to generate, up to and including a full Homology Domain of a LAMP protein. These additional added amino acids can be derived from the Homology Domain from which the Cysteine Conserved Fragment is derived or from other LAMP Protein Homology Domains. Thus, as used herein, a LAMP Homology Domain comprises and/or consists of one Cysteine Conserved Fragment. At least two LAMP Homology Domains make up the Lumenal Domain of LAMP-1, LAMP-2, LAMP-3, or Endolyn.

Specifically, in one preferred embodiment, the improved LAMP Construct comprises at least one cancer antigen described in Table 1 (preferably the sequences/fragments/epitopes described in column 4 of Table 1) and/or the combinations described in the following paragraph fused to the N-terminus of the lumenal domain of a LAMP protein, at least one homology domain of a LAMP protein, or at least one Cysteine Conserved Fragment of a LAMP protein. See, for example ILC-2 and ILC-6 of FIG. 1. In preferred embodiments, these constructs also comprise a transmembrane domain of a LAMP protein, and/or the cytosolic tail of a LAMP protein. In other preferred embodiments, when an antigen contains a transmembrane domain, the transmembrane domain of a LAMP protein and/or the cytosolic tail of a LAMP protein is unnecessary. In preferred embodiments, two homology domains are included in the improved LAMP Construct (e.g., ILC-1 of FIG. 1). In further preferred embodiments, the two homology domains are derived from a LAMP-1, LAMP-2, LAMP-3, or an Endolyn protein. Alternatively, the two homology domains are derived from different LAMP proteins. In these constructs comprising two homology domains, a LAMP hinge domain may also be included. The improved LAMP Constructs described in this paragraph are unexpected in view of the prior art as the antigen has always been placed in between the full lumenal LAMP-1 domain and the full LAMP-1 transmembrane/cytoplasmic tail, as fragments of the lumenal domain have not been reported to be effective in generating a robust immune response.

In another preferred embodiment, the improved LAMP Construct comprises at least one cancer antigen described in Table 1 (preferably the sequences/fragments/epitopes described in column 4 of Table 1) and/or the combinations described in the following paragraph fused to the C-terminus of a single homology domain of a LAMP protein or a single Cysteine Conserved Fragment of a LAMP protein (e.g., ILC-5 of FIG. 1). In preferred embodiments, these constructs also comprise a transmembrane domain of a LAMP protein, and/or the cytosolic tail of a LAMP protein (e.g., ILC-3 of FIG. 1) In other preferred embodiments, when an antigen contains a transmembrane domain, the transmembrane domain of a LAMP protein and/or the cytosolic tail of a LAMP protein is unnecessary. Cancer antigens described in Table 1 can also be inserted into the complete LAMP constructs as depicted in FIG. 1. Alternatively, two homology domains from two different LAMP proteins may be used. The improved LAMP Constructs described in this paragraph are unexpected in view of the prior art as the antigen has always been placed in between the full lumenal LAMP-1 domain and the full LAMP-1 transmembrane/cytoplasmic tail, as fragments of the lumenal domain have not been reported to be effective in generating a robust immune response.

Thus, the improved LAMP Construct comprises at least one cancer antigen described in Table 1 (preferably the sequences/fragments/epitopes described in column 4 of Table 1) and/or the combinations described in the following paragraph fused to the C-terminus of a single homology domain of a LAMP protein or a single Cysteine Conserved Fragment of a LAMP protein. See, for example, ILC-3 and ILC-5 of FIG. 1. In preferred embodiments, these constructs also comprise a transmembrane domain of a LAMP protein, and/or the cytosolic tail of a LAMP protein. In other preferred embodiments, when an antigen contains a transmembrane domain, the transmembrane domain of a LAMP protein and/or the cytosolic tail of a LAMP protein is unnecessary. The improved LAMP Constructs described in this paragraph are unexpected in view of the prior art as described above.

In another preferred embodiment, the improved LAMP Construct comprises at least one antigen of interest fused in between a first homology domain of a LAMP protein and a second homology domain of a LAMP protein (or at least between two Cysteine Conserved Fragments). See, for example, ILC-4 of FIG. 1. In preferred embodiments, the two homology domains are derived from LAMP-1, LAMP-2, LAMP-3, or an Endolyn protein. In these constructs, the antigen may be placed in the LAMP hinge region. Alternatively, two homology domains from two different LAMP proteins may be used. This arrangement of at least one cancer antigen described in Table 1 (preferably the sequences/fragments/epitopes described in column 4 of Table 1) and/or the combinations described in the following paragraph fused in between two LAMP homology domains (including Cysteine Conserved Fragments) is unexpected in view of the prior art as described above.

Each of the improved LAMP Constructs defined above can be generated using the domains defined in the Figures. For example, it is specifically contemplated that the domains included in the improved LAMP Construct illustrated in FIG. 1, for example, can originate from sequences derived from orthologous sequences. See, FIGS. 3-10 for example. It is expressly contemplated that the equivalent domains defined in FIGS. 2A and 2B be used to generate the improved LAMP Constructs illustrated in FIG. 1 for orthologous sequences. Moreover, the orthologous sequences shown in FIGS. 3-10 are representative of the sequences that can be used to generate the domains. It is well within the skill in the art to identify other orthologous sequences and/or isotypes and comparing them to the alignments shown in FIGS. 3-10. Thus, by identifying the equivalent boundaries defined in FIGS. 2A and 2B for a human LAMP protein with the alignments shown in FIGS. 3-10, one can generate the improved LAMP Constructs illustrated in FIG. 1.

As would be well understood by the skilled artisan, the boundaries of each domain are an approximation and may be adjusted at least 1, 2, 3, 4, 5, 6, 7, 8, 9, or 10 amino acids based on cloning considerations and restriction enzyme placement. Therefore, when a particular domain (e.g., a LAMP Homology Domain) is included in the improved LAMP Construct, the amino acids beginning and ending of the domain may be adjust by at least 1, 2, 3, 4, 5, 6, 7, 8, 9, or 10 amino acids as those boundaries defined in FIG. 2A.

Each of the improved LAMP Constructs described above can additionally comprise a signal sequence and/or additional amino acids in between each domain for cloning purposes as is well known in the art. Additionally, the LAMP homologous domains, the LAMP lumenal domain, the LAMP transmembrane domain, and/or the LAMP cytosolic tail domain can originate from the same LAMP protein (e.g., human LAMP-1) or different LAMP proteins (e.g., lumenal domain from human LAMP-1 and transmembrane domain from human LAMP-2, and/or mixing of orthologous domains in the same gene family (e.g., LAMP-1) or different gene family (LAMP-1 and LAMP-2).

Polypeptide variants of the described LAMP Constructs are contemplated. For example, polypeptides at least about 60%, at least about 70%, at least about 75%, at least about 80%, at least about 85%, at least about 90%, at least about 95%, 96%, 97%, 98% or 99% identity to any of the improved LAMP Constructs described herein as well as polynucleotides encoding these variants. Variants of the improved LAMP Constructs retain the ability to function by targeting the antigenic sequence to the lysosome. For example, a modified lumenal sequence must retain the ability to traffic both membrane and non-membrane antigenic materials to an endosomal compartment with at least about 50%, at least about 60%, at least 70%, at least about 80%, at least about 90%, or at least about 100% efficacy compared to the original domain sequence, i.e., an efficacy that results in sufficient antigen presentation by a cell comprising the chimeric sequence for it to mount an immune response. In one aspect, sequences containing a suitable trafficking signal may be identified by constructing an improved LAMP Construct containing the well-characterized antigenic domain of ovalbumin, a transmembrane domain, and the cytoplasmic domain of a protein containing a putative lysosomal/endosomal targeting signal. Efficiency of targeting can be measured by determining the ability of antigen presenting cells, expressing the improved LAMP Construct, to stimulate HA epitope-specific, MHC class II restricted T-cells (see, e.g., Example 5 of U.S. Pat. No. 5,633,234).

Polynucleotides encoding any of the described improved LAMP Constructs are preferred embodiments of the invention, along with polynucleotides at least about 60%, at least about 70%, at least about 75%, at least about 80%, at least about 85%, at least about 90%, at least about 95%, 96%, 97%, 98% or 99% identity to any of the improved LAMP Construct polynucleotides described herein. Variants of the improved LAMP Constructs retain the ability to function by targeting the antigenic sequence to the lysosome. For example, a modified lumenal sequence must retain the ability to traffic both membrane and non-membrane antigenic materials to an endosomal compartment with at least about 50%, at least about 60%, at least 70%, at least about 80%, at least about 90%, or at least about 100% efficacy compared to the original domain sequence, i.e., an efficacy that results in sufficient antigen presentation by a cell comprising the chimeric sequence for it to mount an immune response. In one aspect, sequences containing a suitable trafficking signal may be identified by constructing an improved LAMP Construct containing the well-characterized antigenic domain of ovalbumin, a transmembrane domain, and the cytoplasmic domain of a protein containing a putative lysosomal/endosomal targeting signal. Efficiency of targeting can be measured by determining the ability of antigen presenting cells, expressing the improved LAMP Construct, to stimulate HA epitope-specific, MHC class II restricted T-cells (see, e.g., Example 5 of U.S. Pat. No. 5,633,234).

Cancer Antigens

The following antigens shown in Table 1 can be cloned into each of the LAMP Constructs described herein using techniques well known to the skilled artisan. The sequences/fragments/epitopes described in the fourth column can be also cloned into the improved LAMP Constructs as described herein. Moreover, it is specifically contemplated that any one of the cancer antigen listed in Table 1 can be combined with any other antigen listed in Table 1 (including the sequences/fragments/epitopes described in the fourth column) and inserted into the improved LAMP Constructs as described herein.

| SEQ ID NO: | Protein Name of each Antigen | Accession/ Derived From | Preferred Epitopes/Fragments that can be cloned into the LAMP Constructs described herein, comprise at least. . . |
|---|---|---|---|
| 114 | pp65 | ABQ23593 | The highlighted epitopes shown in FIG. 20, which include LLQTGIHVRVSQPSL (SEQ ID NO: 702) and/or ALPLKMLNIPSINVH (SEQ ID NO: 703) and/or DQYVKVYLESFCEDV (SEQ ID NO: 704) and/or IIKPGKISHIMLDVAFTSH (SEQ ID NO: 705) and/or PQYSEHPTFTSQYRIQGKL (SEQ ID NO: 706) and/or PPWQAGILARNLVPMV (SEQ ID NO: 707) and/or |

| SEQ ID NO: | Protein Name of each Antigen | Accession/ Derived From | Preferred Epitopes/Fragments that can be cloned into the LAMP Constructs described herein, comprise at least... |
|---|---|---|---|
| | | | KYQEFFWDANDIYRIFA (SEQ ID NO: 708) wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 115 and SEQ ID NO: 116. |
| 117 and 118 | gB | P06473 | The highlighted epitopes shown in Figure 20, which include TTSAQTRSVYSQHVT (SEQ ID NO: 711) and/or QLIPDDYSNTHSTRYV (SEQ ID NO: 712) and/or VSVFETSGGLVVFWQ (SEQ ID NO: 713) and/or NSAYEYVDYLFKRMIDLS (SEQ ID NO: 714) wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 119 and SEQ ID NO: 120. |
| 121 | IE1 | P13202 | The highlighted epitopes shown in FIG. 20, which include VLAELVKQIKVRVDMVRHRIKEHMLKKYTQ (SEQ ID NO: 715) and/or IVPEDKREMWMACIKELH (SEQ ID NO: 716) and/or KDELRRKMMYMCYRNIEFFTKNSAFPKTT (SEQ ID NO: 717) and/or SVMKRRIEEICMKVFAQYI (SEQ ID NO: 718) and/or AIAEESDEEEAIVAY (SEQ ID NO: 719) and/or VKSEPVSEIEEVAPEEEDG (SEQ ID NO: 720) wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 122 and SEQ ID NO: 123. |
| 124 | Morphological transforming region II ("MTRII") | AAA66543 | SEQ ID NO: 125 |
| 126 | US28 | AMJ53524 | SEQ ID NO: 127 |
| 128 | IGFBP2 | NP_000588 | (a) about amino acids 39-328 of SEQ ID NO: 128; (b) about amino acids 40-328 of SEQ ID NO: 128; (c) about amino acids 43-135 of SEQ ID NO: 128; (d) about amino acids 1-163 of SEQ ID NO: 128; (e) about amino acids 2-163 of SEQ ID NO: 128; (f) about amino acids 39-163 of SEQ ID NO: 128; (g) about amino acids 40-163 of SEQ ID NO: 128; (h) about amino acids 229-309 of SEQ ID NO: 128; (i) amino acids 2-328 of SEQ ID NO: 128; and/or (j) about amino acids 1-328 of SEQ ID NO: 128 |
| 129 | HCMVA Viral interleukin-10 ("IL10") | P17150 | SEQ ID NO: 130 |
| 131 | HCMVM Membrane glycoprotein UL144 ("UL144") | F5HAM0 | SEQ ID NO: 132 |
| 133 | HCMVM Protein UL141 ("UL141") | Q6RJQ3 | SEQ ID NO: 134 |
| 135 | HCMVA Unique short US11 glycoprotein ("US11") | P09727 | SEQ ID NO: 136 |
| 137 and 138 | HCMV Envelope glycoprotein H OS ("HOS") | A0A0G2TM81 | The highlighted epitopes shown in FIG. 20, which include TYNSSLRNSTVVRENAISFNFFQSYNQYYVFHMPR (SEQ ID NO: 721) and/or DLTETLERYQQRLNTYALVSKDLASYRSFS (SEQ ID NO: and/or SHTTSGLHRPHFNQTCILFD (SEQ ID NO: 723) and/or |

| SEQ ID NO: | Protein Name of each Antigen | Accession/ Derived From | Preferred Epitopes/Fragments that can be cloned into the LAMP Constructs described herein, comprise at least... |
|---|---|---|---|
| | | | QLNRHSYLKDPDFLDAALDF (SEQ ID NO: 724) wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 139 and SEQ ID NO: 140. |
| 141 | HCMVT Viral transcription factor IE2 ("IE2") | Q6SWP7 | The highlighted epitopes shown in FIG. 20, which include RRGRVKIDEVSRMFR (SEQ ID NO: 725) and/or GIQIIYTRNHEVKSE (SEQ ID NO: 726) and/or LSTPFLMEHTMPVTHPPEVA (SEQ ID NO: 727) wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 142 and SEQ ID NO: 143. |
| 144 | TERT Isoform 1 ("TERT") | NP_937983.2 | SEQ ID NO: 145<br>SEQ ID NO: 146 |
| 147 | Survivin | NP_001125727 | SEQ ID NO: 147; representative constructs include SEQ ID NO: 193-197. |
| 148 | Tetanus | 1AF9_A | The highlighted epitopes shown in FIG. 20, which include PGINGKAIHLVNNESSE (SEQ ID NO: 728) and/or FNNFTVSFWLRVPK VSASHLEQYGT (SEQ ID NO: 729) and/or YVSIDKFRIFCKALNPKEIE KLYTSYLS (SEQ ID NO: 730) and/or ILRVGYNAPGIPLYKKMEAVKLR DLK (SEQ ID NO: 731) wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 149 and SEQ ID NO: 150. |
| 151 | Cancer Testis Antigen NY-ESO-1 ("NY-ESO-1") | NP-001318.1 (SEQ ID NO: 151) | Amino acids 1-155 of SEQ ID NO: 151<br>Amino acids 80-155 of SEQ ID NO: 151 |
| 152 | HER2 | AAA75493.1 (SEQ ID NO: 152) | Construct comprising at least one of: amino acids 23-652 and/or 690-1255 of SEQ ID NO: 152 wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 153 and SEQ ID NO: 154. |
| 155 | HER3 | NP_001973.2 (SEQ ID NO: 155) | Construct comprising at least one of: amino acids 20-643, 665-1201, and/or 1209-1342 of SEQ ID NO: 155, wherein each epitope can be combined in any order and/or in any combination and cloned into a LAMP Construct described herein, wherein each epitope is preferably separated by a linker, such as, for example GPGPG (SEQ ID NO: 709) or PMGLP (SEQ ID NO: 710). Representative construct inserts are shown as SEQ ID NO: 156 and SEQ ID NO: 157 |
| 158 | HVEM | NP_003811.2 (SEQ ID NO: 158) | Amino acids 39-202 (SEQ ID NO: 159) |
| 160-163 | HPV Constructs | | Sequences used to create the constructs: (a) HPV 16 E6 (SEQ ID NO: 160); (b) HPV 18 E6 (SEQ ID NO: 161); (c) HPV 16 E7 (SEQ ID NO: 162); (d) HPV 18 E7 (SEQ ID NO: 163) Representative Constructs:<br>SEQ ID NO: 164 (Representative HPV 16 E6-E7 Construct)<br>SEQ ID NO: 165 (Representative HPV 18 E6-E7 Construct)<br>SEQ ID NO: 166 (HPV 16 E6 - linker-HPV 18 E6-linker-HPV 16 E7-linker-HPV 18 E7) |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 169-172 | EBV Constructs | | Any of the following sequences, in any combination, could be used to create the constructs (a) EBV EBNA1 (SEQ ID NO: 169); (b) EBV Truncated EBNA-1 (SEQ ID NO: 170); (c) EBV gp350 (SEQ ID NO: 171); (d) EBV LMP2 (SEQ ID NO: 172). For example, a representative construct could comprise truncated EBNA-1 and LMP2. |
| 174-175 | HBV Constructs | | Any of the following sequences could be used (in either orientation) to create the constructs: HBV Middle S Protein (SEQ ID NO: 174) and HBV X Protein (SEQ ID NO: 175). For example, a representative construct could comprise Middle S Protein - X protein. |
| 176 | TIGIT | | SEQ ID NO: 176 |
| 177 | TEM8 | | SEQ ID NO: 177 |
| 178 | TEM1 | | SEQ ID NO: 178 |
| 179 | HER2 ECD + TM | | SEQ ID NO: 179 |
| 180 | CEA | | SEQ ID NO: 180 |
| 181 | TARP | | SEQ ID NO: 181 |
| 182 | PROSTEIN | | SEQ ID NO: 182 |
| 183 | PSMA | | SEQ ID NO: 183 |
| 184 | BIRC4 | | SEQ ID NO: 184 |
| 185 | Mucin-1 | | SEQ ID NO: 185 |
| 186 | Mucin-1 Isoform | | SEQ ID NO: 186 |
| 187 | CD40 Ligand | | SEQ ID NO: 187 |
| 188 | WT-1 | | SEQ ID NO: 188 |
| 189 | WT-1 Truncated | | SEQ ID NO: 189 |
| 190 | PRAME | | SEQ ID NO: 190 |
| 191 | LAGE-1 | | SEQ ID NO: 191 |
| 192 | MAGE A3 | | SEQ ID NO: 192 |
| 198 | 1A01_HLA-A/m | UniProtKB: P30443 | SEQ ID NO: 198 |
| 199 | 1A02 | UniProtKB: P01892 | SEQ ID NO: 199 |
| 200 | 5T4 | UniProtKB: Q13641 | SEQ ID NO: 200 |
| 201 | ACRBP | UniProtKB: Q8NEB7 | SEQ ID NO: 201 |
| 202 | AFP | UniProtKB: P02771 | SEQ ID NO: 202 |
| 203 | AKAP4 | UniProtKB: Q5JQC9 | SEQ ID NO: 203 |
| 204 | alpha-actinin-_4/m | UniProtKB: B4DSX0 | SEQ ID NO: 204 |
| 205 | alpha-actinin-_4/m | UniProtKB: B4E337 | SEQ ID NO: 205 |
| 206 | alpha-actinin-_4/m | UniProtKB: O43707 | SEQ ID NO: 206 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 207 | alpha-methylacyl-coenzyme_A_racemase | UniProtKB: A0A024RE16 | SEQ ID NO: 207 |
| 208 | alpha-methylacyl-coenzyme_A_racemase | UniProtKB: A8KAC3 | SEQ ID NO: 208 |
| 209 | ANDR | UniProtKB: P10275 | SEQ ID NO: 209 |
| 210 | ART-4 | UniProtKB: Q9ULX3 | SEQ ID NO: 210 |
| 211 | ARTC1/m | UniProtKB: P52961 | SEQ ID NO: 211 |
| 212 | AURKB | UniProtKB: Q96GD4 | SEQ ID NO: 212 |
| 213 | B2MG | UniProtKB: P61769 | SEQ ID NO: 213 |
| 214 | B3GN5 | UniProtKB: Q9BYG0 | SEQ ID NO: 214 |
| 215 | B4GN1 | UniProtKB: Q00973 | SEQ ID NO: 215 |
| 216 | B7H4 | UniProtKB: Q7Z7D3 | SEQ ID NO: 216 |
| 217 | BAGE-1 | UniProtKB: Q13072 | SEQ ID NO: 217 |
| 218 | BASI | UniProtKB: P35613 | SEQ ID NO: 218 |
| 219 | BCL-2 | UniProtKB: A9QXG9 | SEQ ID NO: 219 |
| 220 | bcr/abl | UniProtKB: A9UEZ4 | SEQ ID NO: 220 |
| 221 | bcr/abl | UniProtKB: A9UEZ7 | SEQ ID NO: 221 |
| 222 | bcr/abl | UniProtKB: A9UEZ8 | SEQ ID NO: 222 |
| 223 | bcr/abl | UniProtKB: A9UEZ9 | SEQ ID NO: 223 |
| 224 | bcr/abl | UniProtKB: A9UF00 | SEQ ID NO: 224 |
| 225 | bcr/abl | UniProtKB: A9UF01 | SEQ ID NO: 225 |
| 226 | bcr/abl | UniProtKB: A9UF03 | SEQ ID NO: 226 |
| 227 | bcr/abl | UniProtKB: A9UF04 | SEQ ID NO: 227 |
| 228 | bcr/abl | UniProtKB: A9UF05 | SEQ ID NO: 228 |
| 229 | bcr/abl | UniProtKB: A9UF06 | SEQ ID NO: 229 |
| 230 | bcr/abl | UniProtKB: A9UF08 | SEQ ID NO: 230 |
| 231 | beta-catenin/m | UniProtKB: P35222 | SEQ ID NO: 231 |
| 232 | beta-catenin/m | UniProtKB: Q8WYA6 | SEQ ID NO: 232 |
| 233 | BING-4 | UniProtKB: O15213 | SEQ ID NO: 233 |
| 234 | BIRC7 | UniProtKB: Q96CA5 | SEQ ID NO: 234 |
| 235 | BRCA1/m | UniProtKB: A0A024R1V0 | SEQ ID NO: 235 |
| 236 | BRCA1/m | UniProtKB: A0A024R1V7 | SEQ ID NO: 236 |
| 237 | BRCA1/m | UniProtKB: A0A024R1Z8 | SEQ ID NO: 237 |
| 238 | BRCA1/m | UniProtKB: A0A068BFX7 | SEQ ID NO: 238 |
| 239 | BRCA1/m | UniProtKB: C6YB45 | SEQ ID NO: 239 |
| 240 | BRCA1/m | UniProtKB: C6YB47 | SEQ ID NO: 240 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 241 | BRCA1/m | UniProtKB: G3XAC3 | SEQ ID NO: 241 |
| 242 | BY55 | UniProtKB: O95971 | SEQ ID NO: 242 |
| 243 | CAMEL | UniProtKB: O95987 | SEQ ID NO: 243 |
| 244 | CASPA | UniProtKB: Q92851-4 | SEQ ID NO: 244 |
| 245 | cathepsin_B | UniProtKB: A0A024R374 | SEQ ID NO: 245 |
| 246 | cathepsin_B | UniProtKB: P07858 | SEQ ID NO: 246 |
| 247 | cathepsin_L | UniProtKB: A0A024R276 | SEQ ID NO: 247 |
| 248 | cathepsin_L | UniProtKB: P07711 | SEQ ID NO: 248 |
| 249 | cathepsin_L | UniProtKB: Q9HBQ7 | SEQ ID NO: 249 |
| 250 | CD1A | UniProtKB: P06126 | SEQ ID NO: 250 |
| 251 | CD1B | UniProtKB: P29016 | SEQ ID NO: 251 |
| 252 | CD1C | UniProtKB: P29017 | SEQ ID NO: 252 |
| 253 | CD1D | UniProtKB: P15813 | SEQ ID NO: 253 |
| 254 | CD1E | UniProtKB: P15812 | SEQ ID NO: 254 |
| 255 | CD20 | UniProtKB: P11836 | SEQ ID NO: 255 |
| 256 | CD22 | UniProtKB: O60926 | SEQ ID NO: 256 |
| 257 | CD22 | UniProtKB: P20273 | SEQ ID NO: 257 |
| 258 | CD22 | UniProtKB: Q0EAF5 | SEQ ID NO: 258 |
| 259 | CD276 | UniProtKB: Q5ZPR3 | SEQ ID NO: 259 |
| 260 | CD33 | UniProtKB: B4DF51 | SEQ ID NO: 260 |
| 261 | CD33 | UniProtKB: P20138 | SEQ ID NO: 261 |
| 262 | CD33 | UniProtKB: Q546G0 | SEQ ID NO: 262 |
| 263 | CD3E | UniProtKB: P07766 | SEQ ID NO: 263 |
| 264 | CD3Z | UniProtKB: P20963 | SEQ ID NO: 264 |
| 265 | CD44_Isoform 1 | UniProtKB: P16070 | SEQ ID NO: 265 |
| 266 | CD44_Isoform 6 | UniProtKB: P16070-6 | SEQ ID NO: 266 |
| 267 | CD4 | UniProtKB: P01730 | SEQ ID NO: 267 |
| 268 | CD52 | UniProtKB: P31358 | SEQ ID NO: 268 |
| 269 | CD52 | UniProtKB: Q6IBD0 | SEQ ID NO: 269 |
| 270 | CD52 | UniProtKB: V9HWN9 | SEQ ID NO: 270 |
| 271 | CD55 | UniProtKB: B1AP15 | SEQ ID NO: 271 |
| 272 | CD55 | UniProtKB: D3DT85 | SEQ ID NO: 272 |
| 273 | CD55 | UniProtKB: D3DT86 | SEQ ID NO: 273 |
| 274 | CD55 | UniProtKB: P08174 | SEQ ID NO: 274 |
| 275 | CD56 | UniProtKB: P13591 | SEQ ID NO: 275 |
| 276 | CD80 | UniProtKB: A0N0P2 | SEQ ID NO: 276 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 277 | CD80 | UniProtKB: P33681 | SEQ ID NO: 277 |
| 278 | CD86 | UniProtKB: P42081 | SEQ ID NO: 278 |
| 279 | CD8A | UniProtKB: P01732 | SEQ ID NO: 279 |
| 280 | CDC27/m | UniProtKB: G5EA36 | SEQ ID NO: 280 |
| 281 | CDC27/m | UniProtKB: P30260 | SEQ ID NO: 281 |
| 282 | CDE30 | UniProtKB: P28908 | SEQ ID NO: 282 |
| 283 | CDK4/m | UniProtKB: A0A024RBB6 | SEQ ID NO: 283 |
| 284 | CDK4/m | UniProtKB: P11802 | SEQ ID NO: 284 |
| 285 | CDK4/m | UniProtKB: Q6LC83 | SEQ ID NO: 285 |
| 286 | CDK4/m | UniProtKB: Q96BE9 | SEQ ID NO: 286 |
| 287 | CDKN2A/m | UniProtKB: D1LYX3 | SEQ ID NO: 287 |
| 288 | CDKN2A/m | UniProtKB: G3XAG3 | SEQ ID NO: 288 |
| 289 | CDKN2A/m | UniProtKB: K7PML8 | SEQ ID NO: 289 |
| 290 | CDKN2A/m | UniProtKB: L8E941 | SEQ ID NO: 290 |
| 291 | CDKN2A/m | UniProtKB: Q8N726 | SEQ ID NO: 291 |
| 292 | CEA | RefSeq: NP 004354 | SEQ ID NO: 292 |
| 293 | CEAM6 | UniProtKB: P40199 | SEQ ID NO: 293 |
| 294 | CH3L2 | UniProtKB: Q15782 | SEQ ID NO: 294 |
| 295 | CLCA2 | UniProtKB: Q9UQC9 | SEQ ID NO: 295 |
| 296 | CML28 | UniProtKB: Q9NQT4 | SEQ ID NO: 296 |
| 297 | CML66 | UniProtKB: Q96RS6 | SEQ ID NO: 297 |
| 298 | COA-1/m | UniProtKB: Q5T124 | SEQ ID NO: 298 |
| 299 | coactosin-like_protein | UniProtKB: Q14019 | SEQ ID NO: 299 |
| 300 | collagen_XXIII | UniProtKB: L8EAS4 | SEQ ID NO: 300 |
| 301 | collagen_XXIII | UniProtKB: Q86Y22 | SEQ ID NO: 301 |
| 302 | COX-2 | UniProtKB: Q6ZYK7 | SEQ ID NO: 302 |
| 303 | CP1B1 | UniProtKB: Q16678 | SEQ ID NO: 303 |
| 304 | CSAG2 | UniProtKB: Q9Y5P2-2 | SEQ ID NO: 304 |
| 305 | CSAG2 | UniProtKB: Q9Y5P2 | SEQ ID NO: 305 |
| 306 | CT45A1 | UniProtKB: Q5HYN5 | SEQ ID NO: 306 |
| 307 | CT55 | UniProtKB: Q8WUE5 | SEQ ID NO: 307 |
| 308 | CT-_9/BRD6 | UniProtKB: Q58F21 | SEQ ID NO: 308 |
| 309 | CTAG2_Isoform_LAGE-1A | UniProtKB: O75638-2 | SEQ ID NO: 309 |
| 310 | CTAG2_Isoform_LAGE-1B | UniProtKB: O75638 | SEQ ID NO: 310 |
| 311 | CTCFL | UniProtKB: Q8NI51 | SEQ ID NO: 311 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 312 | Cten | UniProtKB: Q8IZW8 | SEQ ID NO: 312 |
| 313 | cyclin_B1 | UniProtKB: P14635 | SEQ ID NO: 313 |
| 314 | cyclin_D1 | UniProtKB: P24385 | SEQ ID NO: 314 |
| 315 | cyp-B | UniProtKB: P23284 | SEQ ID NO: 315 |
| 316 | DAM-10 | UniProtKB: P43366 | SEQ ID NO: 316 |
| 317 | DEPIA | UniProtKB: Q5TB30 | SEQ ID NO: 317 |
| 318 | E7 | UniProtKB: P03129 | SEQ ID NO: 318 |
| 319 | E7 | UniProtKB: P06788 | SEQ ID NO: 319 |
| 320 | E7 | UniProtKB: P17387 | SEQ ID NO: 320 |
| 321 | E7 | UniProtKB: P06429 | SEQ ID NO: 321 |
| 322 | E7 | UniProtKB: P27230 | SEQ ID NO: 322 |
| 323 | E7 | UniProtKB: P24837 | SEQ ID NO: 323 |
| 324 | E7 | UniProtKB: P21736 | SEQ ID NO: 324 |
| 325 | E7 | UniProtKB: P26558 | SEQ ID NO: 325 |
| 326 | E7 | UniProtKB: P36831 | SEQ ID NO: 326 |
| 327 | E7 | UniProtKB: P36833 | SEQ ID NO: 327 |
| 328 | E7 | UniProtKB: Q9QCZ1 | SEQ ID NO: 328 |
| 329 | E7 | UniProtKB: Q81965 | SEQ ID NO: 329 |
| 330 | E7 | UniProtKB: Q80956 | SEQ ID NO: 330 |
| 331 | EF1A2 | UniProtKB: Q05639 | SEQ ID NO: 331 |
| 332 | EFTUD2/m | UniProtKB: Q15029 | SEQ ID NO: 332 |
| 333 | EGFR | UniProtKB: A0A0B4J1Y5 | SEQ ID NO: 333 |
| 334 | EGFR | UniProtKB: E7BSV0 | SEQ ID NO: 334 |
| 335 | EGFR | UniProtKB: L0R6G1 | SEQ ID NO: 335 |
| 336 | EGFR | UniProtKB: P00533-2 | SEQ ID NO: 336 |
| 337 | EGFR | UniProtKB: P00533 | SEQ ID NO: 337 |
| 338 | EGFR | UniProtKB: Q147T7 | SEQ ID NO: 338 |
| 339 | EGFR | UniProtKB: Q504U8 | SEQ ID NO: 339 |
| 340 | EGFR | UniProtKB: Q8NDU8 | SEQ ID NO: 340 |
| 341 | EGLN3 | UniProtKB: Q9H6Z9 | SEQ ID NO: 341 |
| 342 | ELF2/m | UniProtKB: B7Z720 | SEQ ID NO: 342 |
| 343 | EMMPRIN | UniProtKB: Q54A51 | SEQ ID NO: 343 |
| 344 | EpCam | UniProtKB: P16422 | SEQ ID NO: 344 |
| 345 | EphA2 | UniProtKB: P29317 | SEQ ID NO: 345 |
| 346 | EphA3 | UniProtKB: P29320 | SEQ ID NO: 346 |
| 347 | EphA3 | UniProtKB: Q6P4R6 | SEQ ID NO: 347 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 348 | ErbB3 | UniProtKB: B3KWG5 | SEQ ID NO: 348 |
| 349 | ErbB3 | UniProtKB: B4DGQ7 | SEQ ID NO: 349 |
| 350 | ERBB4 | UniProtKB: Q15303 | SEQ ID NO: 350 |
| 351 | ERG | UniProtKB: P11308 | SEQ ID NO: 351 |
| 352 | ETV6 | UniProtKB: P41212 | SEQ ID NO: 352 |
| 353 | EWS | UniProtKB: Q01844 | SEQ ID NO: 353 |
| 354 | EZH2 | UniProtKB: F2YMM1 | SEQ ID NO: 354 |
| 355 | EZH2 | UniProtKB: G3XAL2 | SEQ ID NO: 355 |
| 356 | EZH2 | UniProtKB: L0R8S5 | SEQ ID NO: 356 |
| 357 | EZH2 | UniProtKB: Q15910 | SEQ ID NO: 357 |
| 358 | EZH2 | UniProtKB: S4S3R8 | SEQ ID NO: 358 |
| 359 | FABP7 | UniProtKB: Q15540 | SEQ ID NO: 359 |
| 360 | FCGR3A_Version 1 | UniProtKB: P08637 | SEQ ID NO: 360 |
| 361 | FCGR3A_Version 2 | CCDS: CCDS1232.1 | SEQ ID NO: 361 |
| 362 | FGF5 | UniProtKB: P12034 | SEQ ID NO: 362 |
| 363 | FGF5 | UniProtKB: Q60518 | SEQ ID NO: 363 |
| 364 | FGFR2 | UniProtKB: P21802 | SEQ ID NO: 364 |
| 365 | fibronectin | UniProtKB: A0A024R516 | SEQ ID NO: 365 |
| 366 | fibronectin | UniProtKB: A0A024RB01 | SEQ ID NO: 366 |
| 367 | fibronectin | UniProtKB: A0A024RDT9 | SEQ ID NO: 367 |
| 368 | fibronectin | UniProtKB: A0A024RDV5 | SEQ ID NO: 368 |
| 369 | fibronectin | UniProtKB: A6NH44 | SEQ ID NO: 369 |
| 370 | fibronectin | UniProtKB: A8K6A5 | SEQ ID NO: 370 |
| 371 | fibronectin | UniProtKB: B2R627 | SEQ ID NO: 371 |
| 372 | fibronectin | UniProtKB: B3KXM5 | SEQ ID NO: 372 |
| 373 | fibronectin | UniProtKB: B4DIC5 | SEQ ID NO: 373 |
| 374 | fibronectin | UniProtKB: B4DN21 | SEQ ID NO: 374 |
| 375 | fibronectin | UniProtKB: B4DS98 | SEQ ID NO: 375 |
| 376 | fibronectin | UniProtKB: B4DTH2 | SEQ ID NO: 376 |
| 377 | fibronectin | UniProtKB: B4DTK1 | SEQ ID NO: 377 |
| 378 | fibronectin | UniProtKB: B4DU16 | SEQ ID NO: 378 |
| 379 | fibronectin | UniProtKB: B7Z3W5 | SEQ ID NO: 379 |
| 380 | fibronectin | UniProtKB: B7Z939 | SEQ ID NO: 380 |
| 381 | fibronectin | UniProtKB: G5E9X3 | SEQ ID NO: 381 |
| 382 | fibronectin | UniProtKB: Q9H382 | SEQ ID NO: 382 |
| 383 | FOS | UniProtKB: P01100 | SEQ ID NO: 383 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 384 | FOXP3 | UniProtKB: Q9BZS1 | SEQ ID NO: 384 |
| 385 | FUT1 | UniProtKB: P19526 | SEQ ID NO: 385 |
| 386 | G250 | UniProtKB: Q16790 | SEQ ID NO: 386 |
| 387 | GAGE-1 | Genbank: AAA82744 | SEQ ID NO: 387 |
| 388 | GAGE-2 | UniProtKB: Q6NT46 | SEQ ID NO: 388 |
| 389 | GAGE-3 | UniProtKB: Q13067 | SEQ ID NO: 389 |
| 390 | GAGE-4 | UniProtKB: Q13068 | SEQ ID NO: 390 |
| 391 | GAGE-5 | UniProtKB: Q13069 | SEQ ID NO: 391 |
| 392 | GAGE-6 | UniProtKB: Q13070 | SEQ ID NO: 392 |
| 393 | GAGE7b | UniProtKB: O76087 | SEQ ID NO: 393 |
| 394 | GAGE-8_(GAGE-2D) | UniProtKB: Q9UEU5 | SEQ ID NO: 394 |
| 395 | GASR | UniProtKB: P32239 | SEQ ID NO: 395 |
| 396 | GnT-V | UniProtKB: Q09328 | SEQ ID NO: 396 |
| 397 | GPC3 | UniProtKB: 16QJG3 | SEQ ID NO: 397 |
| 398 | GPC3 | UniProtKB: P51654 | SEQ ID NO: 398 |
| 399 | GPC3 | UniProtKB: Q8IYG2 | SEQ ID NO: 399 |
| 400 | GPNMB/m | UniProtKB: A0A024RA55 | SEQ ID NO: 400 |
| 401 | GPNMB/m | UniProtKB: Q14956 | SEQ ID NO: 401 |
| 402 | GPNMB/m | UniProtKB: Q8IXJ5 | SEQ ID NO: 402 |
| 403 | GPNMB/m | UniProtKB: Q96F58 | SEQ ID NO: 403 |
| 404 | GRM3 | UniProtKB: Q14832 | SEQ ID NO: 404 |
| 405 | HAGE | UniProtKB: Q9NXZ2 | SEQ ID NO: 405 |
| 406 | hepsin | UniProtKB: B2ZDQ2 | SEQ ID NO: 406 |
| 407 | hepsin | UniProtKB: P05981 | SEQ ID NO: 407 |
| 408 | Her2/neu | UniProtKB: B4DTR1 | SEQ ID NO: 408 |
| 409 | Her2/neu | UniProtKB: L8E8G2 | SEQ ID NO: 409 |
| 410 | Her2/neu | UniProtKB: P04626 | SEQ ID NO: 410 |
| 411 | Her2/neu | UniProtKB: Q9UK79 | SEQ ID NO: 411 |
| 412 | HLA-A2/m | UniProtKB: Q95387 | SEQ ID NO: 412 |
| 413 | HLA-A2/m | UniProtKB: Q9MYF8 | SEQ ID NO: 413 |
| 414 | homeobox_NKX3.1 | UniProtKB: Q99801 | SEQ ID NO: 414 |
| 415 | HOM-TES-85 | UniProtKB: B2RBQ6 | SEQ ID NO: 415 |
| 416 | HOM-TES-85 | UniProtKB: Q9P127 | SEQ ID NO: 416 |
| 417 | HPG1 | Pubmed: 12543784 | SEQ ID NO: 417 |
| 418 | HS71A | UniProtKB: P0DMV8 | SEQ ID NO: 418 |
| 419 | HS71B | UniProtKB: P0DMV9 | SEQ ID NO: 419 |
| 420 | HST-2 | UniProtKB: P10767 | SEQ ID NO: 420 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 421 | hTERT | UniProtKB: O94807 | SEQ ID NO: 421 |
| 422 | iCE | UniProtKB: O00748 | SEQ ID NO: 422 |
| 423 | IF2B3 | UniProtKB: O00425 | SEQ ID NO: 423 |
| 424 | IL-13Ra2 | UniProtKB: Q14627 | SEQ ID NO: 424 |
| 425 | IL2-RA | UniProtKB: P01589 | SEQ ID NO: 425 |
| 426 | IL2-RB | UniProtKB: P14784 | SEQ ID NO: 426 |
| 427 | IL2-RG | UniProtKB: P31785 | SEQ ID NO: 427 |
| 428 | IMP3 | UniProtKB: Q9NV31 | SEQ ID NO: 428 |
| 429 | ITA5 | UniProtKB: P08648 | SEQ ID NO: 429 |
| 430 | ITB1 | UniProtKB: P05556 | SEQ ID NO: 430 |
| 431 | ITB6 | UniProtKB: P18564 | SEQ ID NO: 431 |
| 432 | kallikrein-2 | UniProtKB: A0A024R4J4 | SEQ ID NO: 432 |
| 433 | kallikrein-2 | UniProtKB: A0A024R4N3 | SEQ ID NO: 433 |
| 434 | kallikrein-2 | UniProtKB: B0AZU9 | SEQ ID NO: 434 |
| 435 | kallikrein-2 | UniProtKB: B4DU77 | SEQ ID NO: 435 |
| 436 | kallikrein-2 | UniProtKB: P20151 | SEQ ID NO: 436 |
| 437 | kallikrein-2 | UniProtKB: Q6T774 | SEQ ID NO: 437 |
| 438 | kallikrein-2 | UniProtKB: Q6T775 | SEQ ID NO: 438 |
| 439 | kallikrein-4 | UniProtKB: A0A0C4DFQ5 | SEQ ID NO: 439 |
| 440 | kallikrein-4 | UniProtKB: Q5BQA0 | SEQ ID NO: 440 |
| 441 | kallikrein-4 | UniProtKB: Q96PT0 | SEQ ID NO: 441 |
| 442 | kallikrein-4 | UniProtKB: Q96PT1 | SEQ ID NO: 442 |
| 443 | kallikrein-4 | UniProtKB: Q9Y5K2 | SEQ ID NO: 443 |
| 444 | KI20A | UniProtKB: O95235 | SEQ ID NO: 444 |
| 445 | KIAA0205 | UniProtKB: Q92604 | SEQ ID NO: 445 |
| 446 | KIF2C | UniProtKB: Q99661 | SEQ ID NO: 446 |
| 447 | KK-LC-1 | UniProtKB: Q5H943 | SEQ ID NO: 447 |
| 448 | LDLR | UniProtKB: P01130 | SEQ ID NO: 448 |
| 449 | LGMN | UniProtKB: Q99538 | SEQ ID NO: 449 |
| 450 | LIRB2 | UniProtKB: Q8N423 | SEQ ID NO: 450 |
| 451 | LY6K | UniProtKB: Q17RY6 | SEQ ID NO: 451 |
| 452 | MAGA5 | UniProtKB: P43359 | SEQ ID NO: 452 |
| 453 | MAGA8 | UniProtKB: P43361 | SEQ ID NO: 453 |
| 454 | MAGAB | UniProtKB: P43364 | SEQ ID NO: 454 |
| 455 | MAGE-A10 | UniProtKB: A0A024RC14 | SEQ ID NO: 455 |

| SEQ ID NO: | Protein Name of each Antigen | Accession/ Derived From | Preferred Epitopes/Fragments that can be cloned into the LAMP Constructs described herein, comprise at least... |
|---|---|---|---|
| 456 | MAGE-A12 | UniProtKB: P43365 | SEQ ID NO: 456 |
| 457 | MAGE-A1 | UniProtKB: P43355 | SEQ ID NO: 457 |
| 458 | MAGE-A2 | UniProtKB: P43356 | SEQ ID NO: 458 |
| 459 | MAGE-A3 | UniProtKB: P43357 | SEQ ID NO: 459 |
| 460 | MAGE-A4 | UniProtKB: A0A024RC12 | SEQ ID NO: 460 |
| 461 | MAGE-A4 | UniProtKB: P43358 | SEQ ID NO: 461 |
| 462 | MAGE-A4 | UniProtKB: Q1RN33 | SEQ ID NO: 462 |
| 463 | MAGE-A6 | UniProtKB: A8K072 | SEQ ID NO: 463 |
| 464 | MAGE-A6 | UniProtKB: P43360 | SEQ ID NO: 464 |
| 465 | MAGE-A6 | UniProtKB: Q6FHI5 | SEQ ID NO: 465 |
| 466 | MAGE-A9 | UniProtKB: P43362 | SEQ ID NO: 466 |
| 467 | MAGE-B10 | UniProtKB: Q96LZ2 | SEQ ID NO: 467 |
| 468 | MAGE-B16 | UniProtKB: A2A368 | SEQ ID NO: 468 |
| 469 | MAGE-B17 | UniProtKB: A8MXT2 | SEQ ID NO: 469 |
| 470 | MAGE- B1 | UniProtKB: Q96TG1 | SEQ ID NO: 470 |
| 471 | MAGE-B2 | UniProtKB: O15479 | SEQ ID NO: 471 |
| 472 | MAGE-B3 | UniProtKB: O15480 | SEQ ID NO: 472 |
| 473 | MAGE-B4 | UniProtKB: O15481 | SEQ ID NO: 473 |
| 474 | MAGE-B5 | UniProtKB: Q9BZ81 | SEQ ID NO: 474 |
| 475 | MAGE-B6 | UniProtKB: Q8N7X4 | SEQ ID NO: 475 |
| 476 | MAGE-C1 | UniProtKB: O60732 | SEQ ID NO: 476 |
| 477 | MAGE-C2 | UniProtKB: Q9UBF1 | SEQ ID NO: 477 |
| 478 | MAGE-C3 | UniProtKB: Q8TD91 | SEQ ID NO: 478 |
| 479 | MAGE-D1 | UniProtKB: Q9Y5V3 | SEQ ID NO: 479 |
| 480 | MAGE-D2 | UniProtKB: Q9UNF1 | SEQ ID NO: 480 |
| 481 | MAGE-D4 | UniProtKB: Q96JG8 | SEQ ID NO: 481 |
| 482 | MAGE- E1 | UniProtKB: Q6IAI7 | SEQ ID NO: 482 |
| 483 | MAGE-E1_(MAGE1) | UniProtKB: Q9HCI5 | SEQ ID NO: 483 |
| 484 | MAGE-E2 | UniProtKB: Q8TD90 | SEQ ID NO: 484 |
| 485 | MAGE-F1 | UniProtKB: Q9HAY2 | SEQ ID NO: 485 |
| 486 | MAGE-H1 | UniProtKB: Q9H213 | SEQ ID NO: 486 |
| 487 | MAGEL2 | UniProtKB: Q9UJ55 | SEQ ID NO: 487 |
| 488 | mammaglobin_A | UniProtKB: Q13296 | SEQ ID NO: 488 |
| 489 | mammaglobin_A | UniProtKB: Q6NX70 | SEQ ID NO: 489 |
| 490 | MART-1/melan-A | UniProtKB: Q16655 | SEQ ID NO: 490 |
| 491 | MART-2 | UniProtKB: Q5VTY9 | SEQ ID NO: 491 |
| 492 | MC1_R | UniProtKB: Q01726 | SEQ ID NO: 492 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 493 | MC1_R | UniProtKB: Q1JUL4 | SEQ ID NO: 493 |
| 494 | MC1_R | UniProtKB: Q1JUL6 | SEQ ID NO: 494 |
| 495 | MC1_R | UniProtKB: Q1JUL8 | SEQ ID NO: 495 |
| 496 | MC1_R | UniProtKB: Q1JUL9 | SEQ ID NO: 496 |
| 497 | MC1_R | UniProtKB: Q1JUM0 | SEQ ID NO: 497 |
| 498 | MC1_R | UniProtKB: Q1JUM2 | SEQ ID NO: 498 |
| 499 | MC1_R | UniProtKB: Q1JUM3 | SEQ ID NO: 499 |
| 500 | MC1_R | UniProtKB: Q1JUM4 | SEQ ID NO: 500 |
| 501 | MC1_R | UniProtKB: Q1JUM5 | SEQ ID NO: 501 |
| 502 | MC1_R | UniProtKB: Q6UR92 | SEQ ID NO: 502 |
| 503 | MC1_R | UniProtKB: Q6UR94 | SEQ ID NO: 503 |
| 504 | MC1_R | UniProtKB: Q6UR95 | SEQ ID NO: 504 |
| 505 | MC1_R | UniProtKB: Q6UR96 | SEQ ID NO: 505 |
| 506 | MC1_R | UniProtKB: Q6UR97 | SEQ ID NO: 506 |
| 507 | MC1_R | UniProtKB: Q6UR98 | SEQ ID NO: 507 |
| 508 | MC1_R | UniProtKB: Q6UR99 | SEQ ID NO: 508 |
| 509 | MC1_R | UniProtKB: Q6URA0 | SEQ ID NO: 509 |
| 510 | MC1_R | UniProtKB: Q86YW1 | SEQ ID NO: 510 |
| 511 | MC1_R | UniProtKB: V9Q5S2 | SEQ ID NO: 511 |
| 512 | MC1_R | UniProtKB: V9Q671 | SEQ ID NO: 512 |
| 513 | MC1_R | UniProtKB: V9Q783 | SEQ ID NO: 513 |
| 514 | MC1_R | UniProtKB: V9Q7F1 | SEQ ID NO: 514 |
| 515 | MC1_R | UniProtKB: V9Q8N1 | SEQ ID NO: 515 |
| 516 | MC1_R | UniProtKB: V9Q977 | SEQ ID NO: 516 |
| 517 | MC1_R | UniProtKB: V9Q9P5 | SEQ ID NO: 517 |
| 518 | MC1_R | UniProtKB: V9Q9R8 | SEQ ID NO: 518 |
| 519 | MC1_R | UniProtKB: V9QAE0 | SEQ ID NO: 519 |
| 520 | MC1_R | UniProtKB: V9QAR2 | SEQ ID NO: 520 |
| 521 | MC1_R | UniProtKB: V9QAW3 | SEQ ID NO: 521 |
| 522 | MC1_R | UniProtKB: V9QB02 | SEQ ID NO: 522 |
| 523 | MC1_R | UniProtKB: V9QB58 | SEQ ID NO: 523 |
| 524 | MC1_R | UniProtKB: V9QBY6 | SEQ ID NO: 524 |
| 525 | MC1_R | UniProtKB: V9QC17 | SEQ ID NO: 525 |
| 526 | MC1_R | UniProtKB: V9QC66 | SEQ ID NO: 526 |
| 527 | MC1_R | UniProtKB: V9QCQ4 | SEQ ID NO: 527 |
| 528 | MC1_R | UniProtKB: V9QDF4 | SEQ ID NO: 528 |
| 529 | MC1_R | UniProtKB: V9QDN7 | SEQ ID NO: 529 |
| 530 | MC1_R | UniProtKB: V9QDQ6 | SEQ ID NO: 530 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 531 | mesothelin | UniProtKB: Q13421 | SEQ ID NO: 531 |
| 532 | MITF | UniProtKB: O75030-8 | SEQ ID NO: 532 |
| 533 | MITF | UniProtKB: O75030-9 | SEQ ID NO: 533 |
| 534 | MITF | UniProtKB: O75030 | SEQ ID NO: 534 |
| 535 | MMP1_1 | UniProtKB: B3KQS8 | SEQ ID NO: 535 |
| 536 | MMP7 | UniProtKB: P09237 | SEQ ID NO: 536 |
| 537 | MUC-1 | Genbank: AAA60019 | SEQ ID NO: 537 |
| 538 | MUM-1/m | RefSeq: NP_116242 | SEQ ID NO: 538 |
| 539 | MUM-2/m | UniProtKB: Q9Y5R8 | SEQ ID NO: 539 |
| 540 | MYO1A | UniProtKB: Q9UBC5 | SEQ ID NO: 540 |
| 541 | MYO1B | UniProtKB: O43795 | SEQ ID NO: 541 |
| 542 | MYO1C | UniProtKB: O00159 | SEQ ID NO: 542 |
| 543 | MYO1D | UniProtKB: O94832 | SEQ ID NO: 543 |
| 544 | MYO1E | UniProtKB: Q12965 | SEQ ID NO: 544 |
| 545 | MYO1F | UniProtKB: O00160 | SEQ ID NO: 545 |
| 546 | MYO1G | UniProtKB: B0I1T2 | SEQ ID NO: 546 |
| 547 | MYO1H | RefSeq: NP_001094891 | SEQ ID NO: 547 |
| 548 | NA17 | UniProtKB: Q3V5L5 | SEQ ID NO: 548 |
| 549 | NA88-A | Pubmed: 10790436 | SEQ ID NO: 549 |
| 550 | Neo-PAP | UniProtKB: Q9BWT3 | SEQ ID NO: 550 |
| 551 | NFYC/m | UniProtKB: Q13952 | SEQ ID NO: 551 |
| 552 | NGEP | UniProtKB: Q6IWH7 | SEQ ID NO: 552 |
| 553 | NPM | UniProtKB: P06748 | SEQ ID NO: 553 |
| 554 | NRCAM | UniProtKB: Q92823 | SEQ ID NO: 554 |
| 555 | NSE | UniProtKB: P09104 | SEQ ID NO: 555 |
| 556 | NUF2 | UniProtKB: Q9BZD4 | SEQ ID NO: 556 |
| 557 | NY-ESO-1 | UniProtKB: P78358 | SEQ ID NO: 557 |
| 558 | OA1 | UniProtKB: P51810 | SEQ ID NO: 558 |
| 559 | OGT | UniProtKB: O15294 | SEQ ID NO: 559 |
| 560 | OS-9 | UniProtKB: B4DH11 | SEQ ID NO: 560 |
| 561 | OS-9 | UniProtKB: B4E321 | SEQ ID NO: 561 |
| 562 | OS-9 | UniProtKB: B7Z8E7 | SEQ ID NO: 562 |
| 563 | OS-9 | UniProtKB: Q13438 | SEQ ID NO: 563 |
| 564 | osteocalcin | UniProtKB: P02818 | SEQ ID NO: 564 |
| 565 | osteopontin | UniProtKB: A0A024RDE2 | SEQ ID NO: 565 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 566 | osteopontin | UniProtKB: A0A024RDE6 | SEQ ID NO: 566 |
| 567 | osteopontin | UniProtKB: A0A024RDJ0 | SEQ ID NO: 567 |
| 568 | osteopontin | UniProtKB: B7Z351 | SEQ ID NO: 568 |
| 569 | osteopontin | UniProtKB: F2YQ21 | SEQ ID NO: 569 |
| 570 | osteopontin | UniProtKB: P10451 | SEQ ID NO: 570 |
| 571 | p53 | UniProtKB: P04637 | SEQ ID NO: 571 |
| 572 | PAGE-4 | UniProtKB: O60829 | SEQ ID NO: 572 |
| 573 | PAI-1 | UniProtKB: P05121 | SEQ ID NO: 573 |
| 574 | PAI-2 | UniProtKB: P05120 | SEQ ID NO: 574 |
| 575 | PAP | UniProtKB: Q06141 | SEQ ID NO: 575 |
| 576 | PAP | UniProtKB: Q53S56 | SEQ ID NO: 576 |
| 577 | PATE | UniProtKB: Q8WXA2 | SEQ ID NO: 577 |
| 578 | PAX3 | UniProtKB: P23760 | SEQ ID NO: 578 |
| 579 | PAX5 | UniProtKB: Q02548 | SEQ ID NO: 579 |
| 580 | PD1L1 | UniProtKB: Q9NZQ7 | SEQ ID NO: 580 |
| 581 | PDCD1 | UniProtKB: Q15116 | SEQ ID NO: 581 |
| 582 | PDEF | UniProtKB: O95238 | SEQ ID NO: 582 |
| 583 | PECA1 | UniProtKB: P16284 | SEQ ID NO: 583 |
| 584 | PGCB | UniProtKB: Q96GW7 | SEQ ID NO: 584 |
| 585 | PGFRB | UniProtKB: P09619 | SEQ ID NO: 585 |
| 586 | Pim-1_-Kinase | UniProtKB: A0A024RD25 | SEQ ID NO: 586 |
| 587 | Pin-1 | UniProtKB: O15428 | SEQ ID NO: 587 |
| 588 | Pin-1 | UniProtKB: Q13526 | SEQ ID NO: 588 |
| 589 | Pin-1 | UniProtKB: Q49AR7 | SEQ ID NO: 589 |
| 590 | PLAC1 | UniProtKB: Q9HBJ0 | SEQ ID NO: 590 |
| 591 | PMEL | UniProtKB: P40967 | SEQ ID NO: 591 |
| 592 | PML | UniProtKB: P29590 | SEQ ID NO: 592 |
| 593 | POTEF | UniProtKB: A5A3E0 | SEQ ID NO: 593 |
| 594 | POTE | UniProtKB: Q86YR6 | SEQ ID NO: 594 |
| 595 | PRAME | UniProtKB: A0A024R1E6 | SEQ ID NO: 595 |
| 596 | PRAME | UniProtKB: P78395 | SEQ ID NO: 596 |
| 597 | PRDX5/m | UniProtKB: P30044 | SEQ ID NO: 597 |
| 598 | PRM2 | UniProtKB: P04554 | SEQ ID NO: 598 |
| 599 | prostein | UniProtKB: Q96JT2 | SEQ ID NO: 599 |
| 600 | proteinase-3 | UniProtKB: D6CHE9 | SEQ ID NO: 600 |
| 601 | proteinase-3 | UniProtKB: P24158 | SEQ ID NO: 601 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 602 | PSA | UniProtKB: P55786 | SEQ ID NO: 602 |
| 603 | PSB9 | UniProtKB: P28065 | SEQ ID NO: 603 |
| 604 | PSCA | UniProtKB: D3DWI6 | SEQ ID NO: 604 |
| 605 | PSCA | UniProtKB: O43653 | SEQ ID NO: 605 |
| 606 | PSGR | UniProtKB: Q9H255 | SEQ ID NO: 606 |
| 607 | PSM | UniProtKB: Q04609 | SEQ ID NO: 607 |
| 608 | PTPRC | RefSeq: NP 002829 | SEQ ID NO: 608 |
| 609 | RAB8A | UniProtKB: P61006 | SEQ ID NO: 609 |
| 610 | RAGE-1 | UniProtKB: Q9UQ07 | SEQ ID NO: 610 |
| 611 | RARA | UniProtKB: P10276 | SEQ ID NO: 611 |
| 612 | RASH | UniProtKB: P01112 | SEQ ID NO: 612 |
| 613 | RASK | UniProtKB: P01116 | SEQ ID NO: 613 |
| 614 | RASN | UniProtKB: P01111 | SEQ ID NO: 614 |
| 615 | RGS5 | UniProtKB: O15539 | SEQ ID NO: 615 |
| 616 | RHAMM/CD168 | UniProtKB: O75330 | SEQ ID NO: 616 |
| 617 | RHOC | UniProtKB: P08134 | SEQ ID NO: 617 |
| 618 | RSSA | UniProtKB: P08865 | SEQ ID NO: 618 |
| 619 | RU1 | UniProtKB: Q9UHJ3 | SEQ ID NO: 619 |
| 620 | RU2 | UniProtKB: Q9UHG0 | SEQ ID NO: 620 |
| 621 | RUNX1 | UniProtKB: Q01196 | SEQ ID NO: 621 |
| 622 | S-100 | UniProtKB: V9HW39 | SEQ ID NO: 622 |
| 623 | SAGE | UniProtKB: Q9NXZ1 | SEQ ID NO: 623 |
| 624 | SART-_1 | UniProtKB: O43290 | SEQ ID NO: 624 |
| 625 | SART-2 | UniProtKB: Q9UL01 | SEQ ID NO: 625 |
| 626 | SART-3 | UniProtKB: Q15020 | SEQ ID NO: 626 |
| 627 | SEPR | UniProtKB: Q12884 | SEQ ID NO: 627 |
| 628 | SIA7F | UniProtKB: Q969X2 | SEQ ID NO: 628 |
| 629 | SIA8A | UniProtKB: Q92185 | SEQ ID NO: 629 |
| 630 | SIAT9 | UniProtKB: Q9UNP4 | SEQ ID NO: 630 |
| 631 | SIRT2/m | UniProtKB: A0A024R0G8 | SEQ ID NO: 631 |
| 632 | SIRT2/m | UniProtKB: Q8IXJ6 | SEQ ID NO: 632 |
| 633 | SOX10 | UniProtKB: P56693 | SEQ ID NO: 633 |
| 634 | SP17 | UniProtKB: Q15506 | SEQ ID NO: 634 |
| 635 | SPNXA | UniProtKB: Q9NS26 | SEQ ID NO: 635 |
| 636 | SPXN3 | UniProtKB: Q5MJ09 | SEQ ID NO: 636 |
| 637 | SSX-1 | UniProtKB: Q16384 | SEQ ID NO: 637 |
| 638 | SSX-2 | UniProtKB: Q16385 | SEQ ID NO: 638 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 639 | SSX3 | UniProtKB: Q99909 | SEQ ID NO: 639 |
| 640 | SSX-4 | UniProtKB: O60224 | SEQ ID NO: 640 |
| 641 | ST1A1 | UniProtKB: P50225 | SEQ ID NO: 641 |
| 642 | STAG2 | UniProtKB: Q8N3U4-2 | SEQ ID NO: 642 |
| 643 | STAMP-1 | UniProtKB: Q8NFT2 | SEQ ID NO: 643 |
| 644 | STEAP-1 | UniProtKB: A0A024RA63 | SEQ ID NO: 644 |
| 645 | STEAP-1 | UniProtKB: Q9UHE8 | SEQ ID NO: 645 |
| 646 | Survivin-2B | UniProtKB: O15392-2 | SEQ ID NO: 646 |
| 647 | survivin | UniProtKB: O15392 | SEQ ID NO: 647 |
| 648 | SYCP1 | UniProtKB: A0A024R012 | SEQ ID NO: 648 |
| 649 | SYCP1 | UniProtKB: B7ZLS9 | SEQ ID NO: 649 |
| 650 | SYCP1 | UniProtKB: Q15431 | SEQ ID NO: 650 |
| 651 | SYCP1 | UniProtKB: Q3MHC4 | SEQ ID NO: 651 |
| 652 | SYT-SSX-1 | UniProtKB: A4PIV7 | SEQ ID NO: 652 |
| 653 | SYT-SSX-1 | UniProtKB: A4PIV8 | SEQ ID NO: 653 |
| 654 | SYT-SSX-2 | UniProtKB: A4PIV9 | SEQ ID NO: 654 |
| 655 | SYT-SSX-2 | UniProtKB: A4PIW0 | SEQ ID NO: 655 |
| 656 | TARP | UniProtKB: Q0VGM3 | SEQ ID NO: 656 |
| 657 | TCRg | UniProtKB: A2JGV3 | SEQ ID NO: 657 |
| 658 | TF2AA | UniProtKB: P52655 | SEQ ID NO: 658 |
| 659 | TGFR2 | UniProtKB: P37173 | SEQ ID NO: 659 |
| 660 | TGM-4 | UniProtKB: B2R7D1 | SEQ ID NO: 660 |
| 661 | TIE2 | UniProtKB: Q02763 | SEQ ID NO: 661 |
| 662 | TKTL1 | UniProtKB: P51854 | SEQ ID NO: 662 |
| 663 | TPI/m | UniProtKB: P60174 | SEQ ID NO: 663 |
| 664 | TRGV11 | UniProtKB: Q99601 | SEQ ID NO: 664 |
| 665 | TRGV9 | UniProtKB: A4D1X2 | SEQ ID NO: 665 |
| 666 | TRGV9 | UniProtKB: Q99603 | SEQ ID NO: 666 |
| 667 | TRGV9 | UniProtKB: Q99604 | SEQ ID NO: 667 |
| 668 | TRPC1 | UniProtKB: P48995 | SEQ ID NO: 668 |
| 669 | TRP-p8 | UniProtKB: Q7Z2W7 | SEQ ID NO: 669 |
| 670 | TSG10 | UniProtKB: Q9BZW7 | SEQ ID NO: 670 |
| 671 | TSPY1 | UniProtKB: Q01534 | SEQ ID NO: 671 |
| 672 | TVC_(TRGV3) | Genbank: M13231.1 | SEQ ID NO: 672 |
| 673 | TX101 | UniProtKB: Q9BY14-2 | SEQ ID NO: 673 |

-continued

| SEQ ID NO: | Protein Name of each Antigen | Accession/ Derived From | Preferred Epitopes/Fragments that can be cloned into the LAMP Constructs described herein, comprise at least... |
|---|---|---|---|
| 674 | tyrosinase | UniProtKB: A0A024DBG7 | SEQ ID NO: 674 |
| 675 | tyrosinase | UniProtKB: L8B082 | SEQ ID NO: 675 |
| 676 | tyrosinase | UniProtKB: L8B086 | SEQ ID NO: 676 |
| 677 | tyrosinase | UniProtKB: L8B0B9 | SEQ ID NO: 677 |
| 678 | tyrosinase | UniProtKB: O75767 | SEQ ID NO: 678 |
| 679 | tyrosinase | UniProtKB: P14679 | SEQ ID NO: 679 |
| 680 | tyrosinase | UniProtKB: U3M8N0 | SEQ ID NO: 680 |
| 681 | tyrosinase | UniProtKB: U3M9D5 | SEQ ID NO: 681 |
| 682 | tyrosinase | UniProtKB: U3M9J2 | SEQ ID NO: 682 |
| 683 | TYRP1 | UniProtKB: P17643 | SEQ ID NO: 683 |
| 684 | TYRP2 | UniProtKB: P40126 | SEQ ID NO: 684 |
| 685 | UPA | UniProtKB: Q96NZ9 | SEQ ID NO: 685 |
| 686 | VEGFR1 | UniProtKB: B5A924 | SEQ ID NO: 686 |
| 687 | WT1 | UniProtKB: A0A0H5AUY0 | SEQ ID NO: 687 |
| 688 | WT1 | UniProtKB: P19544 | SEQ ID NO: 688 |
| 689 | WT1 | UniProtKB: Q06250 | SEQ ID NO: 689 |
| 690 | XAGE1 | UniProtKB: Q9HD64 | SEQ ID NO: 690 |
| 691 | IL-10 | UniProtKB: P22301 | SEQ ID NO: 691 |
| 692 | IL-5 | UniProtKB: P05113 | SEQ ID NO: 692 |
| 693 | M-CSF | UniProtKB: P09603 | SEQ ID NO: 693 |
| 694 | TGFbeta1 | UniProtKB: P01137 | SEQ ID NO: 694 |
| 695 | Caspase_8 | UniProtKB: Q14790 | SEQ ID NO: 695 |
| 696 | SERPINB5 | UniProtKB: P36952 | SEQ ID NO: 696 |
| 697 | calreticulin | UniProtKB: B4DHR1 | SEQ ID NO: 697 |
| 698 | calreticulin | UniProtKB: B4E2Y9 | SEQ ID NO: 698 |
| 699 | calreticulin | UniProtKB: P27797 | SEQ ID NO: 699 |
| 700 | calreticulin | UniProtKB: Q96L12 | SEQ ID NO: 700 |

Additionally, the antigens (including the sequences/fragments/epitopes shown in Column 4) described in Table 1 can be cloned into the LAMP Constructs described herein either individually, or in combination with one another. For example, the names pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3 refer to the proteins described in Table 1 and are explicitly intended to refer generically not only to the full-length sequences shown in Column 1 of Table 1, but also, and preferably, the sequences/fragments/epitopes as described in FIGS. 19 and 20 and in the fourth Column of Table 1. Thus, each one of the sequences shown in Column 1 of Table 1, including the epitopes/fragments described in Column 4 of Table 1 can be used to generate a LAMP Construct. To illustrate different possible combinations, but in no way limiting the disclosure, the combinations of antigens (including the sequences shown in Column 1 of Table 1 and/or the sequences/fragments/epitopes described in Column 4 of Table 1) can be cloned into the LAMP Constructs as follows: (a) pp65 and at least one of gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (b) gB and at least one of pp65, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (c) IE1 and at least one of pp65, gB, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (d) MTRII, and at least one of pp65, gB, IE1, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (e) US28 and at least one of pp65, gB, IE1, MTRII, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (f) IGFBP2 and at least one of pp65, gB, IE1, MTRII, US28, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (g) IL10 and at least one of pp65, gB, IE1, MTRII, US28, IGFBP2, UL144, UL141, US11, HOS, IE2, TERT, Survivin, Tetanus, NY-ESO-1, HER2, HER3, HVEM, HPV16E6, HPV18F6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (h) UL144 and at least one of pp65, gB, IE1, MTRII, US28, IGFBP2, IL10, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (i) UL141 and at least one of pp65, gB, IE1, MTRII, US28, IGFBP2, IL10, UL144, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (j) US11 and at least one of pp65, gB, IE1, MTRII, US28, IGFBP2, IL10, UL144, UL141, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (k) IE2 and at least one of pp65, gB, IE1, MTRII, US28, IGFBP2, IL10, UL144, UL141, US11, HOS, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (l) TERT and at least one of pp65, gB, IE1, MTRII, US28, IGFBP2, IL10, UL144, UL141, US11, HOS, IE2, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (m) Survivin and at least one of pp65, gB, IE1, MTRII, US28, IGFBP2, IL10, UL144, UL141, US11, HOS, IE2, TERT, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (n) Tetanus and at least one of pp65, gB, IE1, MTRII, US28, IGFBP2, IL10, UL144, UL141, US11, HOS, IE2, TERT. Survivin, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (0) NY-ESO-1 and at least one of pp65, gB, IE1, MTRII, US28, IGFBP2, IL10, UL144, UL141, US11, HOS, IE2, TERT, Survivin, Tetanus, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (p) HER2 and at least one of pp65, gB, IE1, MTRII, US28, IGFBP2, IL10, UL144, UL141, US11, HOS, IE2, TERT, Survivin, Tetanus, NY-ESO-1, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (q) HER3 and at least one of pp65, gB, IE1, MTRII, US28, IGFBP2, IL10, UL144, UL141, US11, HOS, IE2, TERT, Survivin, Tetanus, NY-ESO-1, HER2, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (r) HVEM and at least one of pp65, gB, IE1, MTRII, US28, IGFBP2, IL10, UL144, UL141, US11, HOS, IE2, TERT, Survivin, Tetanus, NY-ESO-1, HER2, HER3, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (s) HOS and at least one of pp65, gB, IE1, MTRII, US28, IGFBP2, IL10, UL144, UL141, US11, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (t) HPV16E6 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (u) HPV16E6 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (v) HPV16E7 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (w) HPV18E7 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (x) EBNA1 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (y) EBNA1 trunc and at least one of pp65, gB, IE1, MTRII, US28, IGFBP2, IL10, UL 144, UL141, US11, HOS, IE2, TERT, Survivin, Tetanus, NY-ESO-1, HER2, HER3, HVEM, HPV16E6, HPV18E6, HPV16E7, HPV18E7, EBNA1, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (z) gp350 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (aa) LMP2 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ab) GCP3 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ac) Middle S and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ad) X Protein and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ac) TIGIT and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (af) TEM8 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM1, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ag) TEM1 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, HER2 ECD+TM, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ah) HER2 ECD+TM and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, CEA, TARP, PROSTEIN, PSMA, BIRC4, MUCIN-1, MUCIN-1 iso, CD40-L, WT-1, WT-1 trunc., PRAME, LAGE-1, and/or MAGE A3; (ai) CEA and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, TARP, PROSTEIN, PSMA, BIRC4, MUCIN-1, MUCIN-1 iso, CD40-L, WT-1, WT-1 trunc., PRAME, LAGE-1, and/or MAGE A3; (aj) TARP and at least one of pp65, gB, IE1, MTRII, US28, IGFBP2, IL.10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, PROSTEIN, PSMA, BIRC4, MUCIN-1, MUCIN-1 iso, CD40-L., WT-1, WT-1 trunc., PRAME, LAGE-1, and/or MAGE A3; (ak) PROSTEIN and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PSMA, BIRC4, MUCIN-1, MUCIN-1 iso, CD40-L, WT-1, WT-1 trunc., PRAME, LAGE-1, and/or MAGE A3; (al) PSMA and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, BIRC4, MUCIN-1, MUCIN-1 iso, CD40-L, WT-1, WT-1 trunc., PRAME, LAGE-1, and/or MAGE A3; (am) BIRC4 and at least one of pp65, gB, IE1, MTRII, US28, IGFBP2, IL10, UL 144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, MUCIN-1, MUCIN-1 iso, CD40-L, WT-1, WT-1 trunc., PRAME, LAGE-1, and/or MAGE A3; (an) MUCIN-1 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1 iso, CD40-L, WT-1, WT-1 trunc., PRAME, LAGE-1, and/or MAGE A3; (ao) MUCIN-1 iso and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, CD40-L, WT-1, WT-1 trunc., PRAME, LAGE-1, and/or MAGE A3; (ap) CD40-L and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, WT-1, WT-1 trunc., PRAME, LAGE-1, and/or MAGE A3; (aq) WT-1 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1 trunc., PRAME, LAGE-1, and/or MAGE A3; (ar) WT-1 trunc and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, PRAME, LAGE-1, and/or MAGE A3; (as) PRAME and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., LAGE-1, and/or MAGE A3; (at) LAGE-1 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, and/or MAGE A3; and/or (au) MAGE A3 and at least one of pp65, gB, IE1, MTRII, US28, IGFBP2, IL10, UL144, UL141, US11, HOS, IE2, TERT, Survivin, Tetanus, NY-ESO-1, HER2, HER3, HVEM, HPV16E6, HPV18E6, HPV16E7, HPV18E7, EBNA1, EBNA trunc, gp350, LMP2, GCP3, Middle S, X Protein, TIGIT, TEM8, TEM1, HER2 ECD+TM, CEA, TARP, PROSTEIN, PSMA, BIRC4, MUCIN-1, MUCIN-1 iso, CD40-L, WT-1, WT-1 trunc., PRAME, and/or LAGE-1. The order of the combination of antigens as described above in a particular LAMP construct can vary as this list describes what a LAMP Construct comprises and not necessarily to describe the arrangement of the antigens within a particular construct. Moreover, it is specifically envisioned that these antigens can be combined within a single LAMP Construct, or can be delivered in a composition comprising multiple LAMP Constructs.

Assembly of Sequences Encoding Improved LAMP Constructs

Procedures for constructing improved LAMP Constructs comprising the antigen of interest are well known in the art (see e.g., Williams, et al., J. Cell Biol. 111: 955, 1990). DNA sequences encoding the desired segments can be obtained from readily available recombinant DNA materials such as those available from the American Type Culture Collection, 12301 Parklawn Drive, Rockville, Md. 20852, U.S.A., or from DNA libraries that contain the desired DNA.

For example, the DNA segments corresponding to the desired domain sequences can be assembled with appropriate control and signal sequences using routine procedures of recombinant DNA methodology. See, e.g., as described in U.S. Pat. No. 4,593,002, and Langford, et al., Molec. Cell. Biol. 6: 3191, 1986.

A DNA sequence encoding a protein or polypeptide can be synthesized chemically or isolated by one of several approaches. The DNA sequence to be synthesized can be designed with the appropriate codons for the desired amino acid sequence. In general, one will select preferred codons for the intended host in which the sequence will be used for expression. The complete sequence may be assembled from overlapping oligonucleotides prepared by standard methods and assembled into a complete coding sequence. See, e.g., Edge, Nature 292: 756, 1981; Nambair, et al. Science 223: 1299, 1984; Jay, et al., J. Biol. Chem. 259: 6311, 1984.

In one aspect, one or more of the nucleic acids encoding the domain sequences of the improved LAMP Construct are isolated individually using the polymerase chain reaction (M. A. Innis, et al., In PCR Protocols: A Guide to Methods and Applications, Academic Press, 1990). The domains are preferably isolated from publicly available clones known to contain them, but they may also be isolated from genomic DNA or cDNA libraries. Preferably, isolated fragments are bordered by compatible restriction endonuclease sites which allow an improved LAMP Construct encoding the cancer antigen sequence to be constructed. This technique is well known to those of skill in the art. Domain sequences may be fused directly to each other (e.g., with no intervening sequences), or inserted into one another (e.g., where domain sequences are discontinuous), or may be separated by intervening sequences (e.g., such as linker sequences).

The basic strategies for preparing oligonucleotide primers, probes and DNA libraries, as well as their screening by nucleic acid hybridization, are well known to those of ordinary skill in the art. See, e.g., Sambrook, et al., 1989, supra; Perbal, 1984, supra. The construction of an appropriate genomic DNA or cDNA library is within the skill of the art. See, e.g., Perbal, 1984, supra. Alternatively, suitable DNA libraries or publicly available clones are available from suppliers of biological research materials, such as Clonetech and Stratagene, as well as from public depositories such as the American Type Culture Collection.

Selection may be accomplished by expressing sequences from an expression library of DNA and detecting the expressed peptides immunologically. Clones which express peptides that bind to MHC II molecules and to the desired antibodies/T cell receptors are selected. These selection procedures are well known to those of ordinary skill in the art (see, e.g., Sambrook, et al., 1989, supra).

Once a clone containing the coding sequence for the desired polypeptide sequence has been prepared or isolated, the sequence can be cloned into any suitable vector, preferably comprising an origin of replication for maintaining the sequence in a host cell.

Nucleic Acid Delivery Vehicles

In one aspect, a vaccine composition comprising an improved LAMP Construct is introduced into a cell. The cell may be a host cell for replicating the nucleic acid or for expressing the improved LAMP Construct. Preferably, the host cell for expressing the improved LAMP Construct is an antigen presenting cell (described further below).

In preferred embodiments, the improved LAMP Construct further comprises a polynucleotide sequence for insertion into a target cell and an expression control sequence operably linked thereto to control expression of the polynucleotide sequence (e.g., transcription and/or translation) in the cell. Examples include plasmids, phages, autonomously replicating sequences (ARS), centromeres, and other sequences which are able to replicate or be replicated in vitro or in a host cell (e.g., such as a bacterial, yeast, or insect cell) and/or target cell (e.g., such as a mammalian cell, preferably an antigen presenting cell) and/or to convey the sequences encoding the improved LAMP Construct to a desired location within the target cell.

Recombinant expression vectors may be derived from micro-organisms which readily infect animals, including man, horses, cows, pigs, llamas, giraffes, dogs, cats or chickens. Preferred vectors include those which have already been used as live vaccines, such as vaccinia. These recombinants can be directly inoculated into a host, conferring immunity not only to the microbial vector, but also to express foreign antigens. Preferred vectors contemplated herein as live recombinant vaccines include RNA viruses, adenovirus, herpesviruses, poliovirus, and vaccinia and other pox viruses, as taught in Flexner, Adv. Pharmacol. 21:51, 1990, for example.

Expression control sequences include, but are not limited to, promoter sequences to bind RNA polymerase, enhancer sequences or negative regulatory elements to bind to transcriptional activators and repressors, respectively, and/or translation initiation sequences for ribosome binding. For example, a bacterial expression vector can include a promoter such as the lac promoter and for transcription initiation, the Shine-Dalgarno sequence and the start codon AUG (Sambrook, et al., 1989, supra). Similarly, a eukaryotic expression vector preferably includes a heterologous, homologous, or chimeric promoter for RNA polymerase II, a downstream polyadenylation signal, the start codon AUG, and a termination codon for detachment of a ribosome.

Expression control sequences may be obtained from naturally occurring genes or may be designed. Designed expression control sequences include, but are not limited to, mutated and/or chimeric expression control sequences or synthetic or cloned consensus sequences. Vectors that contain both a promoter and a cloning site into which a polynucleotide can be operatively linked are well known in the art. Such vectors are capable of transcribing RNA in vitro or in vivo, and are commercially available from sources such as Stratagene (La Jolla, Calif.) and Promega Biotech (Madison, Wis.).

In order to optimize expression and/or transcription, it may be necessary to remove, add or alter 5' and/or 3' untranslated portions of the vectors to eliminate extra, or alternative translation initiation codons or other sequences that may interfere with, or reduce, expression, either at the level of transcription or translation. Alternatively, consensus ribosome binding sites can be inserted immediately 5' of the start codon to enhance expression. A wide variety of expression control sequences—sequences that control the expression of a DNA sequence operatively linked to it—may be used in these vectors to express the DNA sequences of this invention. Such useful expression control sequences include, for example, the early or late promoters of SV40, CMV, vaccinia, polyoma, adenovirus, herpes virus and other sequences known to control the expression of genes of mammalian cells, and various combinations thereof.

In one aspect, the improved LAMP Construct comprises an origin of replication for replicating the vector. Preferably, the origin functions in at least one type of host cell which can be used to generate sufficient numbers of copies of the sequence for use in delivery to a target cell. Suitable origins therefore include, but are not limited to, those which function in bacterial cells (e.g., such as *Escherichia* sp., *Salmonella* sp., *Proteus* sp., *Clostridium* sp., *Klebsiella* sp., *Bacillus* sp., *Streptomyces* sp., and *Pseudomonas* sp.), yeast (e.g., such as *Saccharamyces* sp. or *Pichia* sp.), insect cells, and mammalian cells. In one preferred aspect, an origin of replication is provided which functions in the target cell into which the nucleic acid delivery vehicle is introduced (e.g., a mammalian cell, such as a human cell). In another aspect, at least two origins of replication are provided, one that functions in a host cell and one that functions in a target cell.

The improved LAMP Construct may alternatively, or additionally, comprise sequences to facilitate integration of at least a portion of the nucleic acid deliver vector into a target cell chromosome. For example, the improved LAMP Construct may comprise regions of homology to target cell chromosomal DNA. In one aspect, the delivery vector comprises two or more recombination sites which flank a nucleic acid sequence encoding the improved LAMP Construct.

The vector may additionally comprise a detectable and/or selectable marker to verify that the vector has been successfully introduced in a target cell and/or can be expressed by the target cell. These markers can encode an activity, such as, but not limited to, production of RNA, peptide, or protein, or can provide a binding site for RNA, peptides, proteins, inorganic and organic compounds or compositions and the like.

Examples of detectable/selectable markers genes include, but are not limited to: DNA segments that encode products which provide resistance against otherwise toxic compounds (e.g., antibiotics); DNA segments that encode products which are otherwise lacking in the recipient cell (e.g., tRNA genes, auxotrophic markers); DNA segments that encode products which suppress the activity of a gene product; DNA segments that encode products which can be readily identified (e.g., phenotypic markers such as beta-galactosidase, a fluorescent protein (GFP, CFP, YFG, BFP, RFP, EGFP, EYFP, EBFP, dsRed, mutated, modified, or enhanced forms thereof, and the like), and cell surface proteins); DNA segments that bind products which are otherwise detrimental to cell survival and/or function; DNA segments that otherwise inhibit the activity of other nucleic acid segments (e.g., antisense oligonucleotides); DNA segments that bind products that modify a substrate (e.g., restriction endonuclcases); DNA segments that can be used to isolate or identify a desired molecule (e.g., segments encoding specific protein binding sites); primer sequences; DNA segments, which when absent, directly or indirectly confer resistance or sensitivity to particular compounds; and/or DNA segments that encode products which are toxic in recipient cells.

The marker gene can be used as a marker for conformation of successful gene transfer and/or to isolate cells expressing transferred genes and/or to recover transferred genes from a cell. For example, in one aspect, the marker gene is used to isolate and purify antigen presenting cells expressing the improved LAMP Constructs.

Substantially similar genes may be provided, e.g., genes with greater than about 50%, greater than about 70%, greater than 80%, greater than about 90%, and preferably, greater than about 95% identity to a known gene. Substantially similar domain sequences may initially be identified by selecting a sequence which specifically hybridizes to a domain sequence of interest under stringent hybridization conditions. Performing assays to determine the suitability of homologous, variant, or modified domain sequences is merely a matter of screening for sequences which express the appropriate activity. Such screening is routine in the art.

The improved LAMP Construct may be provided as naked nucleic acids or in a delivery vehicle associated with one or more molecules for facilitating entry of a nucleic acid into a cell. Suitable delivery vehicles include, but are not limited to: liposomal formulations, polypeptides, polysaccharides, lipopolysaccharides, viral formulations (e.g., including viruses, viral particles, artificial viral envelopes and the like), cell delivery vehicles, and the like.

Lipid-Based Formulations

Delivery vehicles designed to facilitate intracellular delivery of the improved LAMP Constructs must interact with both non-polar and polar environments (in or on, for example, the plasma membrane, tissue fluids, compartments within the cell, and the like). Therefore, preferably, delivery vehicles are designed to contain both polar and non-polar domains or a translocating sequence for translocating an improved LAMP Construct into a cell.

Compounds having polar and non-polar domains are termed amphiphiles. Cationic amphiphiles have polar groups that are capable of being positively charged at, or around, physiological pH for interacting with negatively charged polynucleotides such as DNA.

The improved LAMP Constructs described herein can be provided in formulations comprising lipid monolayers or bilayers to facilitate transfer of the vectors across a cell membrane. Liposomes or any form of lipid membrane, such as planar lipid membranes or the cell membrane of an intact cell, e.g., a red blood cell, can be used. Liposomal formulations can be administered by any means, including administration intravenously or orally.

Liposomes and liposomal formulations can be prepared according to standard methods and are well known in the art, see, e.g., Remington's; Akimaru, 1995, Cytokines Mol. Ther. 1: 197-210; Alving, 1995, Immunol. Rev. 145: 5-31; Szoka, 1980, Ann. Rev. Biophys. Bioeng. 9: 467; U.S. Pat. Nos. 4,235,871; 4,501,728; and 4,837,028. In one aspect, the liposome comprises a targeting molecule for targeting a liposome:improved LAMP Construct complex to a particular cell type. In a particularly preferred aspect, a targeting molecule comprises a binding partner (e.g., a ligand or receptor) for a biomolecule (e.g., a receptor or ligand) on the surface of a blood vessel or a cell found in a target tissue.

Liposome charge is an important determinant in liposome clearance from the blood, with negatively charged liposomes being taken up more rapidly by the reticuloendothelial system (Juliano, 1975, Biochem. Biophys. Res. Commun. 63: 651) and thus having shorter half-lives in the bloodstream. Incorporating phosphatidylethanolamine derivatives enhances the circulation time by preventing liposomal aggregation. For example, incorporation of N-(omega-carboxy) acylamidophosphatidylethanolamines into large unilamellar vesicles of L-alpha-distearoylphosphatidylcholine dramatically increases the in vivo liposomal circulation lifetime (see, e.g., Ahl, 1997, Biochim. Biophys. Acta 1329: 370-382). Liposomes with prolonged circulation half-lives are typically desirable for therapeutic and diagnostic uses. For a general discussion of pharmacokinetics, see, e.g., Remington's, Chapters 37-39, Lee, et al., In Pharmacokinetic Analysis: A Practical Approach (Technomic Publishing AG, Basel, Switzerland 1996).

Typically, liposomes are prepared with about 5 to 15 mole percent negatively charged phospholipids, such as phosphatidylglycerol, phosphatidylserine or phosphatidyl-inositol. Added negatively charged phospholipids, such as phosphatidylglycerol, also serve to prevent spontaneous liposome aggregation, and thus minimize the risk of undersized liposomal aggregate formation. Membrane-rigidifying agents, such as sphingomyelin or a saturated neutral phospholipid, at a concentration of at least about 50 mole percent, and 5 to 15 mole percent of monosialylganglioside can also impart desirably liposome properties, such as rigidity (see, e.g., U.S. Pat. No. 4,837,028).

Additionally, the liposome suspension can include lipid-protective agents which protect lipids against free-radical and lipid-peroxidative damages on storage. Lipophilic free-radical quenchers, such as alpha-tocopherol and water-soluble iron-specific chelators, such as ferrioxianine, are preferred.

The improved LAMP Constructs of the invention can include multilamellar vesicles of heterogeneous sizes. For example, vesicle-forming lipids can be dissolved in a suitable organic solvent or solvent system and dried under vacuum or an inert gas to form a thin lipid film. If desired, the film can be redissolved in a suitable solvent, such as tertiary butanol, and then lyophilized to form a more homogeneous lipid mixture which is in a more easily hydrated powderlike form. This film is covered with an aqueous solution of the peptide or polypeptide complex and allowed to hydrate, typically over a 15 to 60 minute period with agitation. The size distribution of the resulting multilamellar vesicles can be shifted toward smaller sizes by hydrating the lipids under more vigorous agitation conditions or by adding solubilizing detergents such as deoxycholate. The hydration medium preferably comprises the nucleic acid at a concentration which is desired in the interior volume of the liposomes in the final liposome suspension.

Following liposome preparation, the liposomes can be sized to achieve a desired size range and relatively narrow distribution of liposome sizes. One preferred size range is about 0.2 to 0.4 microns, which allows the liposome suspension to be sterilized by filtration through a conventional filter, typically a 0.22 micron filter. Filter sterilization can be carried out on a high throughput basis if the liposomes have been sized down to about 0.2 to 0.4 microns. Several techniques are available for sizing liposome to a desired size (see, e.g., U.S. Pat. No. 4,737,323).

Suitable lipids include, but are not limited to, DOTMA (Felgner, et al., 1987, Proc. Natl. Acad. Sci. USA 84: 7413-7417), DOGS or Transfectain™ (Behr, et al., 1989, Proc. Natl. Acad. Sci. USA 86: 6982-6986), DNERIE or DORIE (Felgner, et al., Methods 5: 67-75), DC-CHOL (Gao and Huang, 1991, BBRC 179: 280-285), DOTAP™ (McLachlan, et al., 1995, Gene Therapy 2: 674-622), Lipofectamine™. and glycerolipid compounds (see, e.g., EP901463 and WO98/37916).

Other molecules suitable for complexing with the improved LAMP Constructs include cationic molecules, such as, polyamidoamine (Haensler and Szoka, 1993, Bioconjugate Chem. 4: 372-379), dendritic polysine (WO 95/24221), polyethylene irinine or polypropylene h-nine (WO 96/02655), polylysine (U.S. Pat. No. 5,595,897; FR 2 719 316), chitosan (U.S. Pat. No. 5,744,166), DNA-gelatin coarcervates (see, e.g., U.S. Pat. Nos. 6,207,195; 6,025,337; 5,972,707) or DEAE dextran (Lopata, et al., 1984, Nucleic Acid Res. 12: 5707-5717).

Viral-Based Gene Delivery Vehicles

In one aspect, the improved LAMP Construct delivery vehicle comprises a virus or viral particle. In this aspect, preferably, the improved LAMP Construct comprises a viral vector. Viral vectors, such as retroviruses, adenoviruses, adeno-associated viruses and herpes viruses, are often made up of two components, a modified viral genome and a coat structure surrounding it (see, e.g., Smith et al., 1995, Ann. Rev. Microbiol. 49: 807-838), although sometimes viral vectors are introduced in naked form or coated with proteins other than viral proteins. Most current vectors have coat structures similar to a wild-type virus. This structure packages and protects the viral nucleic acid and provides the means to bind and enter target cells.

Preferably, viral vectors comprising the improved LAMP Constructs described herein are modified from wild-type viral genomes to disable the growth of the virus in a target cell while enabling the virus to grow in a host cell (e.g., such as a packaging or helper cell) used to prepare infectious particles. Vector nucleic acids generally essential cis-acting viral sequences for replication and packaging in a helper line and expression control sequences for regulating the expression of a polynucleotide being delivered to a target cell. Other viral functions are expressed in trans in specific packaging or helper cell lines as are known in the art.

Preferred improved LAMP Constructs are viral vectors derived from a virus selected from the group consisting of herpes viruses, cytomegaloviruses, foamy viruses, lentiviruses, Semliki forrest virus, AAV (adeno-associated virus), poxviruses, adenoviruses and retroviruses. Such viral vectors are well known in the art.

In one preferred aspect, a viral vector used is an adenoviral vector. The adenoviral genome consists of a linear double-stranded DNA molecule of approximately 36 kb carrying more than about thirty genes necessary to complete the viral replication cycle. The early genes are divided into 4 regions (E1 to E4) that are essential for viral replication with the exception of the E3 region, which is believed to modulate the anti-viral host immune response. The E1 region (EIA and EIB) encodes proteins responsible for the regulation of transcription of the viral genome. Expression of the E2 region genes (E2A and E2B) leads to the synthesis of the polypeptides needed for viral replication. The proteins encoded by the E3 region prevent cytolysis by cytotoxic T cells and tumor necrosis factor (Wold and Gooding, 1991, Virology 184: 1-8). The proteins encoded by the E4 region are involved in DNA replication, late gene expression and splicing and host cell shut off (Halbert, et al., 1985, J. Virol. 56: 250-257). The late genes generally encode structural proteins contributing to the viral capsid. In addition, the adenoviral genome carries at cis-acting 5' and 3' ITRs (Inverted Terminal Repeat) and packaging sequences essential for DNA replication. The ITRs harbor origins of DNA replication while the encapsidation region is required for the packaging of adenoviral DNA into infectious particles.

Adenoviral vectors can be engineered to be conditionally replicative (CRAd vectors) in order to replicate selectively in specific cells (e.g., such as proliferative cells) as described in Heise and Kim (2000, J. Clin. Invest. 105: 847-85 1). In another aspect, an adenoviral vector is replication-defective for the E1 function (e.g., by total or partial deletion or mutagenesis of E1). The adenoviral backbone of the vector may comprise additional modifications (deletions, insertions or mutations in one or more viral genes). An example of an E2 modification is illustrated by the thermosensitive mutation localized on the DBP (DNA Binding Protein) encoding gene (Ensinger et al., 1972, J. Virol. 10: 328-339). The adenoviral sequence may also be deleted of all or part of the E4 region (see, e.g., EP 974 668; Christ, et al., 2000, Human Gene Ther. 11: 415-427; Lusky, et al., 1999, J. Virol. 73: 8308-8319). Additional deletions within the non-essential E3 region may allow the size of the polynucleotide being delivered to be increased (Yeh, et al., 1997, FASEB Journal 11:615 623). However, it may be advantageous to retain all or part of the E3 sequences coding for polypeptides (e.g., such as gp19k) allowing the virus to escape the immune system (Gooding, et al., 1990, Critical Review of Immunology 10: 53-71) or inflammatory reactions (EP 00440267.3).

Second generation vectors retaining the ITRs and packaging sequences and comprising substantial genetic modifications to abolish the residual synthesis of the viral antigens also may be used in order to improve long-term expression of the expressed gene in the transduced cells (see, e.g., WO 94/28152; Lusky, et al., 1998, J. Virol 72: 2022-2032).

The improved LAMP Constructs being introduced into the cell may be inserted in any location of the viral genome, with the exception of the cis-acting sequences. Preferably, it is inserted in replacement of a deleted region (E1, E3 and/or E4), preferably, within a deleted E1 region.

Adenoviruses can be derived from any human or animal source, in particular canine (e.g. CAV-1 or CAV-2 Genbank ref. CAVIGENOM and CAV77082, respectively), avian (Genbank ref. AAVEDSDNA), bovine (such as BAV3; Reddy, et al., 1998, J. Virol. 72: 1394 1402), murine (Genbank ref. ADRMUSMAVI), ovine, feline, porcine or simian sources or alternatively, may be a hybrid virus. Any serotype can be employed. However, the human adenoviruses of the C sub-group are preferred, especially adenoviruses 2 (Ad2) and 5 (Ad5). Such viruses are available, for example, from the ATCC.

Adenoviral particles or empty adenoviral capsids also can be used to transfer improved LAMP Constructs by a virus-mediated cointernalization process as described in U.S. Pat. No. 5,928,944. This process can be accomplished in the presence of cationic agent(s) such as polycarbenes or lipid vesicles comprising one or more lipid layers.

Adenoviral particles may be prepared and propagated according to any conventional technique in the field of the art (e.g., WO 96/17070) using a complementation cell line or a helper virus, which supplies in trans the missing viral genes necessary for viral replication. The cell lines 293 (Graham et al., 1977, J. Gen. Virol. 36: 59-72) and PERC6 (Fallaux et al., 1998, Human Gene Therapy 9: 1909-1917) are commonly used to complement E1 deletions. Other cell lines have been engineered to complement defective vectors (Yeh, et al., 1996, J. Virol. 70: 559-565; Kroughak and Graham, 1995, Human Gene Ther. 6: 1575-1586; Wang, et al., 1995, Gene Ther. 2: 775-783; Lusky, et al., 1998, J. Virol. 72: 2022-203; EP 919627 and WO 97/04119). The adenoviral particles can be recovered from the culture supernatant but also from the cells after lysis and optionally further purified according to standard techniques (e.g., chromatography, ultracentrifugation, as described in WO 96/27677, WO 98/00524 WO 98/26048 and WO 00/50573).

Cell-type specific targeting may be achieved with vectors derived from adenoviruses having a broad host range by the modification of viral surface proteins. For example, the specificity of infection of adenoviruses is determined by the attachment to cellular receptors present at the surface of permissive cells. In this regard, the fiber and penton present at the surface of the adenoviral capsid play a critical role in cellular attachment (Defer, et al., 1990, J. Virol. 64: 3661-3673). Thus, cell targeting of adenoviruses can be carried out by genetic modification of the viral gene encoding fiber and/or penton, to generate modified fiber and/or penton capable of specific interaction with unique cell surface receptors. Examples of such modifications are described in Wickarn, et al., 1997, J. Virol. 71: 8221-8229; Arriberg, et al., 1997, Virol. Chem 268: 6866-6869; Roux, et al., 1989, Proc. Natl. Acad. Sci. USA 86:9079-9083; Miller and Vile, 1995, FASEB J. 9: 190-199; WO 93/09221, and in WO 95/28494.

In a particularly preferred aspect, adeno-associated viral sequences are used as vectors. Vectors derived from the human parvovirus AAV-2 (adeno-associated virus type 2) are among the most promising gene delivery vehicles currently being developed. Several of the features of this system for packaging a single-stranded DNA suggest it as a possible alternative to naked DNA for delivery. A primary attractive feature, in contrast to other viral vectors such as vaccinia or adenovirus, is that AAV vectors do not express any viral genes. The only viral DNA sequences included in the vaccine construct are the 145 bp inverted terminal repeats (ITR). Thus, as in immunization with naked DNA, the only gene expressed is that of the antigen, or antigen chimera. Additionally, AAV vectors are known to transduce both dividing and non-dividing cells, such as human peripheral blood monocyte-derived dendritic cells, with persistent transgene expression, and with the possibility of oral and intranasal delivery for generation of mucosal immunity. Moreover, the amount of DNA required appears to be much less by several orders of magnitude, with maximum responses at doses of $10^{10}$ to $10^{11}$ particles or copies of DNA in contrast to naked DNA doses of 50 μg or about $10^{15}$ copies.

In one aspect, AAV vectors are packaged by co-transfection of a suitable cell line (e.g., human 293 cells) with the DNA contained in the AAV ITR chimeric protein encoding constructs and an AAV helper plasmid ACG2 containing the AAV coding region (AAV rep and cap genes) without the ITRs. The cells are subsequently infected with the adenovirus Ad5. Vectors can be purified from cell lysates using methods known in the art (e.g., such as cesium chloride density gradient ultracentrifugation) and are validated to ensure that they are free of detectable replication-competent AAV or adenovirus (e.g., by a cytopathic effect bioassay). AAV titer may be determined by quantitative PCR with virus DNA samples prepared after digestion with proteinase K. Preferably, vector titers produced by such a method are approximately $5 \times 10^{12}$ to $1 \times 10^{13}$ DNase resistant particles per ml.

In other aspects, retroviral vectors are used. Retroviruses are a class of integrative viruses which replicate using a virus-encoded reverse transcriptase, to replicate the viral RNA genome into double stranded DNA which is integrated into chromosomal DNA of the infected cells (e.g., target cells). Such vectors include those derived from murine leukemia viruses, especially Moloney (Gilboa, et al., 1988, Adv. Exp. Med. Biol. 241: 29) or Friend's FB29 strains (WO 95/01447). Generally, a retroviral vector is deleted of all or part of the viral genes gag, pol and env and retains 5' and 3' LTRs and an encapsidation sequence. These elements may be modified to increase expression level or stability of the retroviral vector. Such modifications include the replacement of the retroviral encapsidation sequence by one of a retrotransposon such as VL30 (see, e.g., U.S. Pat. No. 5,747,323). Preferably, the improved LAMP Construct is inserted downstream of the encapsidation sequence, preferably in opposite direction relative to the retroviral genome. Cell specific targeting may be achieved by the conjugation of antibodies or antibody fragments to the retroviral envelope protein as is known in the art.

Retroviral particles are prepared in the presence of a helper virus or in an appropriate complementation (packaging) cell line which contains integrated into its genome the retroviral genes for which the retroviral vector is defective (e.g. gag/pol and env). Such cell lines are described in the prior art (Miller and Rosman, 1989, BioTechniques 7: 980; Danos and Mulligan, 1988, Proc. Natl. Acad. Sci. USA 85: 6460; Markowitz, et al., 1988, Virol. 167:400). The product of the env gene is responsible for the binding of the viral particle to the viral receptors present on the surface of the target cell and, therefore determines the host range of the retroviral particle. in the context of the invention, it is advantageous to use a packaging cell line, such as the PA317 cells (ATCC CRL 9078) or 293E16 (WO97/35996) containing an amphotropic envelope protein, to allow infection of human and other species' target cells. The retroviral particles are preferably recovered from the culture supernatant and may optionally be further purified according to standard techniques (e.g. chromatography, ultracentrifugation).

Other suitable viruses include poxviruses. The genome of several members of poxyiridae has been mapped and sequenced. A poxyiral vector may be obtained from any member of the poxyiridae, in particular canarypox, fowlpox and vaccinia virus. Suitable vaccinia viruses include, but are not limited to, the Copenhagen strain (Goebel, et al., 1990, Virol. 179: 247-266; Johnson, et al., 1993, Virol. 196: 381-401), the Wyeth strain and the modified Ankara (MVA) strain (Antoine, et al., 1998, Virol. 244: 365-396). The general conditions for constructing a vaccinia virus vector are known in the art (see, e.g., EP 83 286 and EP 206 920; Mayr et al., 1975, Infection 3:6-14; Sutter and Moss, 1992, Proc. Natl. Acad. Sci. USA 89: 10847-10851). Preferably, the polynucleotide of interest is inserted within a nonessential locus such as the noncoding intergenic regions or any gene for which inactivation or deletion does not significantly impair viral growth and replication.

Poxyiral particles are prepared as described in the art (Piccini, et al., 1987, Methods of Enzymology 153: 545-563; U.S. Pat. Nos. 4,769,330; 4,772,848; 4,603,112; 5,100,587 and 5,179,993). Generally, a donor plasmid is constructed, amplified by growth in $E.$ $coli$ and isolated by conventional procedures. Then, it is introduced into a suitable cell culture (e.g. chicken embryo fibroblasts) together with a poxvirus genome, to produce, by homologous recombination, poxyiral particles. These can be recovered from the culture supernatant or from the cultured cells after a lysis step (e.g., chemical lysis, freezing/thawing, osmotic shock, sonication and the like). Consecutive rounds of plaque purification can be used to remove contaminating wild type virus. Viral particles can then be purified using the techniques known in the art (e.g., chromatographic methods or ultracentrifugation on cesium chloride or sucrose gradients).

The use of vaccinia as a live virus vaccine in the global campaign to eradicate smallpox made vaccinia an obvious choice for development as a live recombinant vaccine vector. Live recombinant vaccinia viruses expressing close to 100 different foreign proteins have been reported, and a number of these are effective experimental vaccines (reviewed by Moss and Flexner, 1987). Vaccinia is particularly versatile as an expression vector because of its large genomic size, capability of accepting at least 25,000 base pairs of foreign DNA, and its ability to infect most eukaryotic cell types, including insect cells (ibid.). Unlike other DNA viruses, poxviruses replicate exclusively in the cytoplasm of infected cells, reducing the possibility of genetic exchange of recombinant viral DNA with the host chromosome. Recombinant vaccinia vectors have been shown to properly process and express proteins from a variety of sources including man, other mammals, parasites, RNA and DNA viruses, bacteria and bacteriophage.

The expression of DNA encoding a foreign protein is controlled by host virus regulatory elements, including upstream promoter sequences and, where necessary, RNA processing signals. Insertion of foreign DNA into nonessential regions of the vaccinia virus genome has been carried out by homologous recombination (Panicali, et al., Proc. Nat'l. Acad. Sci, USA, 79:4927, 1982; Mackett, et al., Proc. Nat'l. Acad. Sci. USA, 79: 7415, 1982).

Expression of cancer antigens by the improved LAMP Construct may occur because of transcriptional regulatory elements at or near the site of insertion or by more precise genetic engineering. Plasmid vectors that greatly facilitate insertion and expression of foreign genes have been constructed (Mackett, et al., J. Virol. 49: 857, 1982). These vectors contain an expression site, composed of a vaccinia transcriptional promoter and one or more unique restriction endonuclease sites for insertion of the foreign coding sequence flanked by DNA from a nonessential region of the vaccinia genome. The choice of promoter determines both the time (e.g., early or late) and level of expression, whereas the flanking DNA sequence determines the site of homologous recombination.

Only about one in a thousand virus particles produced by this procedure is a recombinant. Although recombinant virus plaques can be identified by DNA hybridization, efficient selection procedures have been developed. By using segments of nonessential vaccinia virus thymidine kinase (TK) gene as flanking sequences, the foreign gene recombines into the TK locus and by insertion inactivates the TK gene. Selection of TK virus is achieved by carrying out the virus plaque assay in TK cells in the presents of 5-bromodeoxyuridine. Phosphorylation of the nucleoside analogue and consequent lethal incorporation into viral DNA occurs only in cells infected with TK+ parental virus. Depending on the efficiency of the transfection and recombination, up to 80 of the plaques are desired recombinants, and the rest are spontaneous TK mutants.

Plasmid vectors that contain the $E.$ $coli$ beta-galactosidase gene, as well as an expression site for a second gene, permit an alternative method of distinguishing recombinant from parental virus (Chakrabarti, et al., Mol. Cell. Biol., 5: 3403, 1985). Plaques formed by such recombinants can be positively identified by the blue color that forms upon addition of an appropriate indicator. By combining both TK selection and beta-galactosidase expression, recombinant virus is readily and quickly isolated. The recombinants are then amplified by propagation in suitable cell lines and expression of the inserted gene is checked by appropriate enzymological, immunological or physical procedures.

An upper limit to the amount of genetic information that can be added to the vaccinia virus genome is not yet known. However, the addition of nearly 25,000 base pairs of foreign DNA had no apparent deleterious effect on virus yield (Smith, et al., Gene, 25:21, 1983). Were it necessary, large segments of the vaccinia virus genome could be deleted to provide additional capacity (Moss, et al., J. Virol. 40: 387, 1981).

Viral capsid molecules may include targeting moieties to facilitate targeting and/or entry into cells. Suitable targeting molecules, include, but are not limited to: chemical conjugates, lipids, glycolipids, hormones, sugars, polymers (e.g. PEG, polylysine, PEI and the like), peptides, polypeptides (see, e.g., WO 94/40958), vitamins, antigens, lectins, antibodies and fragments thereof. Preferably, such targeting molecules recognize and bind to cell-specific markers, tissue-specific markers, cellular receptors, viral antigens, antigenic epitopes or tumor-associated markers.

Compositions comprising an improved LAMP Construct based on viral particles may be formulated in the form of doses of between 10 and $10^{14}$ i.u. (infectious units), and preferably, between 10 and $10^{11}$ i.u. The titer may be determined by conventional techniques. The doses of LAMP Constructs are preferably comprised between 0.01 and 10 mg/kg, more especially between 0.1 and 2 mg/kg.

Self-Replicating RNA

Self-replicating RNA virus vectors can also be constructed using the improved LAMP Constructs as described herein. For example, alphaviruses, flaviviruses, measles virus and rhabdoviruses can be used to generate self-replicating RNA virus vaccines. Preferred strains of self-replicating RNA viruses include, but are not limited to rabies virus (RABV), vesicular stomatisitis virus (VSV), West Nile virus, Kunjin virus, Semliki Forest virus (SFV), Sindbis virus (SIN) and/or Venezuelan equine encephalitis virus (VEE).

Self-replicating RNA viruses express the native antigen upon delivery into tissue, thus mimicking live attenuated vaccines without having the risk of reversion to pathogenicity. They also stimulate the innate immune system, thus potentiating responses. See, e.g., Ljungberg, K. "*Self-replicating alphavirus RNA vaccines*," Expert Rev Vaccines (2):177-94 (2015); Lundstrom, K., "*Oncolytic Alphaviruses in Cancer Immunotherapy*", Vaccines 5:9 (2017); Lundstrom, K. "*Replicon RNA Viral Vectors as Vaccines*," Vaccines 4:39 (2016) (hereby incorporated by reference in their entirety). Use of self-replicating vaccines comprising the improved LAMP Constructs described herein can also be used in prime-boost protocols.

Moreover, self-replicating RNA viruses can also be encapsulated by liposomes, as described herein, to improve delivery and targeting. Immunization with self-replicating RNA viruses comprising the improved LAMP Constructs described herein may provide higher transient expression levels of antigens resulting in generation of neutralizing antibody responses and protection against lethal challenges under safe conditions.

Cell-Based Delivery Vehicles

The improved LAMP Constructs according to the invention can be delivered to target cells by means of other cells ("delivery cells") which comprise the constructs. Methods for introducing constructs into cells are known in the art and include microinjection of DNA into the nucleus of a cell (Capechi, et al., 1980, Cell 22: 479-488); transfection with $CaPO_4$ (Chen and Okayama, 1987, Mol. Cell Biol. 7: 2745 2752), electroporation (Chu, et al., 1987, Nucleic Acid Res. 15: 1311-1326); lipofection/liposome fusion (Feigner, et al., 1987, Proc. Natl. Acad. Sci. USA 84: 7413-7417) and particle bombardment (Yang, et al., 1990, Proc. Natl. Acad. Sci. USA 87: 9568-9572). Suitable cells include autologous and non-autologous cells, and may include xenogenic cells. Delivery cells may be induced to deliver their contents to the target cells by inducing their death (e.g., by providing inducible suicide genes to these cells).

Accessory Molecules

The compositions comprising the improved LAMP Constructs according to the invention may comprise one or more accessory molecules for facilitating the introduction of an improved LAMP Construct into a cell and/or for enhancing a particular therapeutic effect and/or enhancing antibody production.

In addition, the composition comprising the improved LAMP Construct according to the present invention may include one or more stabilizing substance(s), such as lipids, nuclease inhibitors, hydrogels, hyaluronidase (WO 98/53853), collagenase, polymers, chelating agents (EP 890362), in order to inhibit degradation within the animal/human body and/or improve transfection/infection of the vector into a target cell. Such substances may be used alone or in combination (e.g., cationic and neutral lipids).

It has also been shown that adenovirus proteins are capable of destabilizing endosomes and enhancing the uptake of DNA into cells. The mixture of adenoviruses to solutions containing a lipid-complexed DNA vector or the binding of DNA to polylysine covalently attached to adenoviruses using protein cross-linking agents may substantially improve the uptake and expression of an improved LAMP Construct (see, e.g., Curiel, et al., 1992, Am. I. Respir. Cell. Mol. Biol. 6: 247-252).

Host Cells

Improved LAMP Constructs according to the invention can be expressed in a variety of host cells, including, but not limited to: prokaryotic cells (e.g., *E. coli, Staphylococcus* sp., *Bacillus* sp.); yeast cells (e.g., *Saccharomyces* sp.); insect cells; nematode cells; plant cells; amphibian cells (e.g., *Xenopus*); avian cells; and mammalian cells (e.g., human cells, mouse cells, mammalian cell lines, primary cultured mammalian cells, such as from dissected tissues).

The molecules can be expressed in host cells isolated from an organism, host cells which are part of an organism, or host cells which are introduced into an organism. In one aspect, improved LAMP Constructs are expressed in host cells in vitro, e.g., in culture. In another aspect, improved LAMP Constructs are expressed in a transgenic organism (e.g., a transgenic mouse, rat, rabbit, pig, primate, etc.) that comprises somatic and/or germline cells comprising nucleic acids encoding the improved LAMP Constructs. Methods for constructing transgenic animals are well known in the art and are routine.

Improved LAMP Constructs also can be introduced into cells in vitro, and the cells (e.g., such as stem cells, hematopoietic cells, lymphocytes, and the like) can be introduced into the host organism. The cells may be heterologous or autologous with respect to the host organism. For example, cells can be obtained from the host organism, improved LAMP Constructs introduced into the cells in vitro, and then reintroduced into the host organism.

Antigen Presenting Cells

In a preferred aspect of the invention, an improved LAMP Construct as described herein is introduced into a natural or engineered antigen presenting cell.

The term "antigen presenting cell" (APC) as used herein intends any cell which presents on its surface an antigen in association with a major histocompatibility complex molecule, preferably a class II molecule, or portion thereof. Examples of suitable APCs are discussed in detail below and include, but are not limited to, whole cells such as macrophages, dendritic cells, B cells, hybrid APCs, and foster antigen presenting cells. Methods of making hybrid APCs are described and known in the art.

Dendritic cells (DCs) are potent antigen-presenting cells. It has been shown that DCs provide all the signals required for T cell activation and proliferation. These signals can be categorized into two types. The first type, which gives specificity to the immune response, is mediated through interaction between the T-cell receptor/CD3 ("TCR/CD3") complex and an antigenic peptide presented by a major histocompatibility complex ("MHC" defined above) class I or II protein on the surface of APCs. This interaction is necessary, but not sufficient, for T cell activation to occur. In fact, without the second type of signals, the first type of signals can result in T cell anergy. The second type of signals, called co-stimulatory signals, is neither antigen-specific nor MHC-restricted, and can lead to a full proliferation response of T cells and induction of T cell effector functions in the presence of the first type of signals.

Several molecules have been shown to enhance co-stimulatory activity. These include, but are not limited to, heat stable antigen (HSA), chondroitin sulfate-modified MHC invariant chain (Ii-CS), intracellular adhesion molecule I (ICAM-1), and B7 co-stimulatory molecule on the surface of APCs and its counter-receptor CD28 or CTLA-4 on T cells.

Other important co-stimulatory molecules are CD40, CD54, CD80, CD86. As used herein, the term "co-stimulatory molecule" encompasses any single molecule or combination of molecules which, when acting together with a peptide/MHC complex bound by a TCR on the surface of a T cell, provides a co-stimulatory effect which achieves activation of the T cell that binds the peptide. The term thus encompasses B7, or other co-stimulatory molecule(s) on an APC, fragments thereof (alone, complexed with another molecule(s), or as part of a fusion protein) which, together with peptide/MHC complex, binds to a cognate ligand and result in activation of the T cell when the TCR on the surface of the T cell specifically binds the peptide. Co-stimulatory molecules are commercially available from a variety of sources, including, for example, Beckman Coulter.

In one aspect of the invention, the method described in Romani et al., J. Immunol. Methods 196: 135-151, 1996, and Bender et al, J. Immunol. Methods 196: 121-135, 1996, are used to generate both immature and mature dendritic cells from the peripheral blood mononuclear cells (PBMCs) of a mammal, such as a murine, simian or human. Briefly, isolated PBMCs are pre-treated to deplete T- and B-cells by means of an immunomagnetic technique. Lymphocyte-depleted PBMC are then cultured for in RPMI medium 9 e.g., about 7 days), supplemented with human plasma (preferably autologous plasma) and GM-CSF/IL-4, to generate dendritic cells. Dendritic cells are nonadherent when compared to their monocyte progenitors. Thus, on approximately day 7, non-adherent cells are harvested for further processing.

The dendritic cells derived from PBMC in the presence of GM-CSF and IL-4 are immature, in that they can lost the nonadherence property and revert back to macrophage cell fate if the cytokine stimuli are removed from the culture. The dendritic cells in an immature state are very effective in processing native protein antigens for the MHC class II restricted pathway (Romani, et al., J. Exp. Med. 169:1169, 1989). Further maturation of cultured dendritic cells is accomplished by culturing for 3 days in a macrophage-conditioned medium (CM), which contains the necessary maturation factors. Mature dendritic cells are less able to capture new proteins for presentation but are much better at stimulating resting T cells (both CD4 and CD8) to grow and differentiate.

Mature dendritic cells can be identified by their change in morphology, such as the formation of more motile cytoplasmic processes; by their nonadherence; by the presence of at least one of the following markers: CD83, CD68, HLA-DR or CD86; or by the loss of Fc receptors such as CD 115 (reviewed in Steinman, Annu. Rev. Immunol. 9: 271, 1991). Mature dendritic cells can be collected and analyzed using typical cytofluorography and cell sorting techniques and devices, such as FACScan and FACStar. Primary antibodies used for flow cytometry are those specific to cell surface antigens of mature dendritic cells and are commercially available. Secondary antibodies can be biotinylated Igs followed by FITC- or PE-conjugated streptavidin.

Alternatively, others have reported that a method for upregulating (activating) dendritic cells and converting monocytes to an activated dendritic cell phenotype. This method involves the addition of calcium ionophore to the culture media convert monocytes into activated dendritic cells. Adding the calcium 21 ionophore A23187, for example, at the beginning of a 24-48 hour culture period resulted in uniform activation and dendritic cell phenotypic conversion of the pooled "monocyte plus DC" fractions: characteristically, the activated population becomes uniformly CD 14 (Leu M3) negative, and upregulates HLA-DR, HLA-DQ, ICAM-1,137.1, and 137.2. Furthermore, this activated bulk population functions as well on a small numbers basis as a further purified. Specific combination(s) of cytokines have been used successfully to amplify (or partially substitute) for the activation/conversion achieved with calcium ionophore: these cytokines include but are not limited to G-CSF, GM-CSF, IL-2, and IL-4. Each cytokine when given alone is inadequate for optimal upregulation.

The second approach for isolating APCs is to collect the relatively large numbers of precommitted APCs already circulating in the blood. Previous techniques for isolating committed APCs from human peripheral blood have involved combinations of physical procedures such as metrizamide gradients and adherence/nonadherence steps (Freudenthal et al. PNAS 87: 7698-7702, 1990); Percoll gradient separations (Mehta-Damani, et al., J. Immunol. 153: 996-1003, 1994); and fluorescence activated cell sorting techniques (Thomas et al., J. Immunol. 151: 6840-52, 1993).

There are many other methods routine in the art for isolating professional antigen presenting cells (or their precursors) and that such methods and others which may be developed are not limiting and are encompassed within the scope of the invention.

In one embodiment, the APCs and therefore the cells presenting one or more antigens are autologous. In another embodiment, the APCs presenting the antigen are allogeneic, i.e., derived from a different subject.

As discussed herein, improved LAMP Constructs can be introduced into APCs using the methods described above or others known in the art, including, but not limited to, transfection, electroporation, fusion, microinjection, viral-based delivery, or cell based delivery. Arthur et al., Cancer Gene Therapy 4(1): 17-25, 1997, reports a comparison of gene transfer methods in human dendritic cells.

Known, partial and putative human leukocyte antigen (HLA), the genetic designation for the human MHC, amino acid and nucleotide sequences, including the consensus sequence, are published (see, e.g., Zemmour and Parham, Immunogenetics 33: 310-320, 1991), and cell lines expressing HLA variants are known and generally available as well, many from the American Type Culture Collection ("ATCC"). Therefore, using PCR, MHC class II-encoding nucleotide sequences are readily operatively linked to an expression vector of this invention that is then used to transform an appropriate cell for expression therein.

Professional APCs can be used, such as macrophages, B cells, monocytes, dendritic cells, and Langerhans cells. These are collected from the blood or tissue of 1) an autologous donor; 2) a heterologous donor having a different HLA specificity then the host to be treated; or 3) from a xenogeneic donor of a different species using standard procedures (Coligan, et. al., Current Protocols in Immunology, sections 3 and 14, 1994). The cells may be isolated from a normal host or a patient having an infectious disease, cancer, autoimmune disease, or allergy.

Professional APCs may be obtained from the peripheral blood using leukopheresis and "FICOLL/HYPAQUE" density gradient centrifugation (stepwise centrifugation through Ficoll and discontinuous Percoll density gradients). Procedures are utilized which avoid the exposure of the APCs to antigens which could be internalized by the APCs, leading to activation of T cells not specific for the antigens of interest.

Cells which are not naturally antigen presenting can be engineered to be antigen presenting by introducing sequences encoding appropriate molecules. For example, nucleic acid sequences encoding MHC class II molecules, accessory molecules, co-stimulatory molecules and antigen processing assisting molecules can be introduced after direct synthesis, cloning, purification of DNA from cells containing such genes, and the like. One expedient means to obtain genes for encoding the molecules used in the improved LAMP Constructs and methods described herein is by polymerase chain reaction (PCR) amplification on selected nucleic acid templates with selected oligonucleotide primer pairs. For example, epithelial cells, endothelial cells, tumor cells, fibroblasts, activated T cells, eosinophils, keratinocytes, astrocytes, microglial cells, thymic cortical epithelial cells, Schwann cells, retinal pigment epithelial cells, myoblasts, vascular smooth muscle cells, chondrocytes, enterocytes, thyrocytes and kidney tubule cells can be used. These may be primary cells recently explanted from a host and not extensively passaged in cell culture to form an established cell line, or established cell lines that are relatively homogeneous and capable of proliferating for many generations or indefinitely.

Cells that are not professional APCs are isolated from any tissue of an autologous donor; a heterologous donor or a xenogeneic donor, where they reside using a variety of known separation methods (Darling, Animal Cells: Culture and Media. J. Wiley, New York, 1994; Freshney, Culture of Animal Cells. Alan R. Liss, Inc., New York, 1987). Non-autologous cells, e.g., heterologous or xenogeneic cells, can be engineered ex vivo to express HLA class I and class II molecules that match known human HLA specificities. These cells can then be introduced into a human subject matching the HLA specificity of the engineered cells. The cells are further engineered ex vivo to express one or more LAMP Constructs according to the invention.

The engineered cells are maintained in cell culture by standard cell culture methods (Darling, Animal Cells: Culture and Media ". J. Wiley, New York, 1994; Freshney, Culture of Animal Cells". Alan R. Liss, Inc., New York, 1987). Cell lines for use in the present invention are obtained from a variety of sources (e.g., ATCC Catalogue of Cell Lines & Hybridomas, American Type Culture Collection, 8th edition, 1995), or are produced using standard methods (Freshney, Culture of Immortalized Cells, Wiley-Liss, New York, 1996). Non-transformed cell lines are preferred for use in human subjects.

In one aspect, CD34+ precursors that are differentiating under the influence of GM-CSF into dendritic cells are obtained from the body of a subject and nucleic acids encoding LAMP Constructs according to the invention are introduced into the cells, which are then injected into the subject. Utilizing the improved LAMP Constructs as described herein will enhance the association of peptides derived from a particular antigen with MHC class II molecules on the transduced antigen presenting cells, resulting in significantly more potent systemic T cell dependent immune responses and/or antibody production. While the antigen presenting cells transfected in this strategy are preferably autologous cells, any MHC class II cells that effectively present antigen in the host may be used as described above.

Peptide Vaccines

Also within the scope of this invention are peptide vaccines encoded by the improved LAMP Construct Preferably, the antigen is processed within the compartment/organelle (or subsequent compartment/organelle to which it is delivered) to generate an epitope bound to an MHC class II molecule capable of modulating an immune response.

The peptide vaccines encoded by the improved LAMP Constructs may also may be bound in a membranous structure to facilitate its administration to the body of an organism. For example, the peptide vaccine encoded by the improved LAMP Construct may be incorporated into liposomes, as described in U.S. Pat. No. 4,448,765.

When a protein or polypeptide is to be used as an immunogen, it may be produced by expression of any one or more of the improved LAMP Constructs described herein in a recombinant cell or it may be prepared by chemical synthesis. For example, the Merrifield technique (Journal of American Chemical Society, vol. 85, pp. 2149-2154, 1968), can be used.

Methods of Producing Antibodies Using LAMP Constructs

The improved LAMP Constructs as polynucleotides, the encoded proteins of the improved LAMP Constructs, and/or cells (such as antigen presenting cells which express the improved LAMP Constructs described herein) can be used to generate antibodies by methods well known by the skilled artisan, such as, for example, methods described in the art. See, for instance, Sutcliffe et al., supra; Wilson et al., supra; Chow et al., Proc. Natl. Acad. Sci. USA 82:910-914 (1985); and Bittle et al., J. Gen. Virol. 66:2347-2354 (1985). If in vivo immunization is used, animals may be immunized with a protein encoded by the improved LAMP Construct and/or a polynucleotide comprising the improved LAMP Construct comprising an antigen as described herein. Priming with improved LAMP Constructs as polynucleotides, the encoded proteins of the improved LAMP Constructs, and/or cells (such as antigen presenting cells which express the improved LAMP Constructs described herein) followed by boosting with an antigen is a preferred embodiment of the invention. In further preferred embodiments, priming with an improved LAMP Construct as described herein followed by boosting with an antigen is specifically contemplated and can be used to generate an even more robust immune response, especially in view of antibody repertoire diversity and titer.

The improved LAMP Construct comprising the antigen may be injected into the non-human vertebrate to raise antibodies. Preparation and injection of LAMP Constructs into non-human vertebrates can be accomplished according to principles of immunization of animals that are well known to those skilled in the art.

The use of an improved LAMP Construct to effectively present the antigen involves, in one aspect, the antigen being processed by LAMP in Antigen Presenting Cells after endocytosis and fusion of the endosome with a lysosome. The endosome then merges with an exocytic vesicle from the Golgi apparatus containing class II MHC molecules, to which the resultant peptides bind. The MHC-peptide complex then trafficks to the plasma membrane where the antigen is available for display to CD4$^+$ T cells.

Animals such as rabbits, rats, mice, llamas, camels, and/or cows can be immunized with the improved LAMP Construct comprising an antigen and/or a polynucleotide encoding the improved LAMP Construct comprising an antigen. Additional animals suitable for immunization include, non-human mammals, such as a rodent (e.g. a guinea pig, a hamster, a rat, a mouse), murine (e.g. a mouse), canine (e.g. a dog), feline (e.g. a cat), equine (e.g. a horse), a primate, simian (e.g. a monkey or ape), a monkey (e.g. marmoset, baboon, rhesus macaque), an ape (e.g. gorilla, chimpanzee, orangutan, gibbon).

For instance, intraperitoneal and/or intradermal injection of emulsions containing about 100 micrograms of an improved LAMP Construct comprising an antigen or carrier protein and Freund's adjuvant or any other adjuvant known for stimulating an immune response may be used. Several booster injections (such as with the recombinant antigen protein) may be needed, for instance, at intervals of about two weeks, to provide a useful titer of an anti-antigen antibody which can be detected, for example, by ELISA assay using free antigen adsorbed, directly or indirectly (e.g., via a biotinylated AviTag), to a solid surface. The titer of anti-antigen antibodies in serum from an immunized animal may be increased by selection of anti-antibodies, for instance, by adsorption to the antigen on a solid support and elution of the selected antibodies according to methods well known in the art.

Alternatively, a polynucleotide encoding the improved LAMP Construct comprising an antigen can also be directly introduced into animals. See, for example, U.S. Pat. Nos. 5,676,954; 6,875,748; 5,661,133; Sahin et al., Nat Rev Drug Discov, 2014 October; 13(10): 759-80; Kariko et al., Mol Ther, 2008 November; 16(11): 1833-40; Kariko et al., Nucleic Acid Res, 2011 November; 39(21): e142; U.S. Pat. No. 6,511,832. In one example, an improved LAMP Construct comprising an antigen is directly injected into a non-human vertebrate. Injection into the animals can occur via intramuscular, intradermal, intranasal, subcutaneous, intravenous, intratracheal, and intrathecal deliveries. Follow-on boosting with a recombinant antigen can also be include in generating the antibodies.

Additionally, antibodies generated by the disclosed methods can be affinity matured using display technology, such as for example, phage display, yeast display or ribosome display. In one example, single chain antibody molecules ("scFvs") displayed on the surface of phage particles are screened to identify those scFvs that immunospecifically bind to the antigen and/or the starting protein. The present invention encompasses both scFvs and portions thereof that are identified to immunospecifically bind to the antigen and/or the starting protein. Such scFvs can routinely be "converted" to immunoglobulin molecules by inserting, for example, the nucleotide sequences encoding the VH and/or VL domains of the scFv into an expression vector containing the constant domain sequences and engineered to direct the expression of the immunoglobulin molecule.

Recombinant expression of the raised antibodies (including scFvs and other molecules comprising, or alternatively consisting of, antibody fragments or variants thereof (e.g., a heavy or light chain of an antibody of the invention or a portion thereof or a single chain antibody of the invention)) using the improved LAMP Construct comprising an antigen and/or a polynucleotide encoding the improved LAMP Construct comprising an antigen of the invention, requires construction of an expression vector(s) containing a polynucleotide that encodes the antibody or fragment or variant thereof. Once a polynucleotide encoding an antibody molecule (e.g., a whole antibody, a heavy or light chain of an antibody, or variant or portion thereof (preferably, but not necessarily, containing the heavy or light chain variable domain)), of the invention has been obtained, the vector(s) for the production of the antibody molecule may be produced by recombinant DNA technology using techniques well known in the art. Thus, methods for preparing an antibody by expressing a polynucleotide containing an antibody encoding nucleotide sequence are described herein. Methods which are well known to those skilled in the art can be used to construct expression vectors containing the antibody coding sequences and appropriate transcriptional and translational control signals. These methods include, for example, in vitro recombinant DNA techniques, synthetic techniques, and in vivo genetic recombination and are described herein. The invention, thus, provides replicable vectors comprising a nucleotide sequence encoding the anti-antigen antibody obtained and isolated as described herein (e.g., a whole antibody, a heavy or light chain of an antibody, a heavy or light chain variable domain of an antibody, or a portion thereof, or a heavy or light chain CDR, a single chain Fv, or fragments or variants thereof), operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464) and the variable domain of the antibody may be cloned into such a vector for expression of the entire heavy chain, the entire light chain, or both the entire heavy and light chains.

The expression vector(s) can be transferred to a host cell by conventional techniques and the transfected cells are then cultured by conventional techniques to produce either the anti-antigen antibody. Thus, the invention includes host cells containing polynucleotide(s) encoding the anti-antigen antibody (e.g., whole antibody, a heavy or light chain thereof, or portion thereof, or a single chain antibody of the invention, or a fragment or variant thereof), operably linked to a heterologous promoter. In preferred embodiments, for the expression of entire antibody molecules, vectors encoding both the heavy and light chains may be co-expressed in the host cell for expression of the entire immunoglobulin molecule, as detailed below.

A variety of host-expression vector systems may be utilized to express anti-antigen antibody. Such host-expression systems represent vehicles by which the coding sequences of interest may be produced and subsequently purified, but also represent cells which may, when transformed or transfected, with the appropriate nucleotide coding sequences, express the anti-antigen antibody. These include, but are not limited to, microorganisms such as bacteria (e.g., *E. coli, B. subtilis*) transformed with recombinant bacteriophage DNA, plasmid DNA or cosmid DNA expression vectors containing sequences; yeast (e.g., *Saccharomyces, Pichia*) transformed with recombinant yeast expression vectors containing coding sequences; insect cell systems infected with recombinant virus expression vectors (e.g., baculovirus) containing coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter). Preferably, bacterial cells such as *Escherichia coli*, and more preferably, eukaryotic cells, are used for the expression of the anti-antigen antibody. For example, mammalian cells such as Chinese hamster ovary cells (CHO), in conjunction with a vector such as the major intermediate early gene promoter element from human cytomegalovirus is an effective expression system (Foecking et al., Gene 45:101 (1986); Cockett et al., Bio/Technology 8:2 (1990)).

In bacterial systems, a number of expression vectors may be advantageously selected depending upon the intended use. For example, when a large quantity of a protein is to be produced (for either antibody production or encoded polypeptides of the improved LAMP Construct), vectors which direct the expression of high levels of fusion protein products that are readily purified may be desirable. Such vectors include, but are not limited to, the *E. coli* expression vector pUR278 (Ruther et al., EMBO 1. 2:1791 (1983)), in which the coding sequence may be ligated individually into the vector in frame with the lac Z coding region so that a fusion protein is produced; pIN vectors (Inouye & Inouye, Nucleic Acids Res. 13:3101-3109 (1985); Van Hecke & Schuster, J. Biol. Chem. 24:5503-5509 (1989)); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or Factor Xa protease cleavage sites so that the cloned target gene product can be released from the GST moiety.

In an insect system, *Autographa californica* nuclear polyhedrosis virus (AcNPV) may be used as a vector to express an anti-antigen antibody or the encoded polypeptides of the improved LAMP Construct. The virus grows in *Spodoptera frugiperda* cells. Coding sequences may be cloned individually into non-essential regions (for example, the polyhedrin gene) of the virus and placed under control of an AcNPV promoter (for example, the polyhedrin promoter).

In mammalian host cells, a number of viral-based expression systems may be utilized express an anti-antigen antibody or the encoded polypeptides of the improved LAMP Construct. In cases where an adenovirus is used as an expression vector, the coding sequence of interest may be ligated to an adenovirus transcription/translation control complex, e.g., the late promoter and tripartite leader sequence. This chimeric gene may then be inserted in the adenovirus genome by in vitro or in vivo recombination.

Insertion in a non-essential region of the viral genome (e.g., region E1 or E3) will result in a recombinant virus that is viable and capable of expressing the anti-antigen antibody or the encoded polypeptides of the improved LAMP Construct in infected hosts (e.g., see Logan & Shenk, Proc. Natl. Acad. Sci. USA 8 1:355-359 (1984)).

Specific initiation signals may also be required for efficient translation of inserted coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see, e.g., Bittner et al., Methods in Enzymol. 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed, to this end, eukaryotic host cells which possess the cellular machinery for proper processing of the primary transcript, glycosylation, and phosphorylation of the gene product may be used. Such mammalian host cells include, but are not limited to, CHO, VERY, BHK, Hela, COS, NSO, MDCK, 293, 3T3, W138, and in particular, breast cancer cell lines such as, for example, BT483, Hs578T, HTB2, BT20 and T47D, and normal mammary gland cell line such as, for example, CRL7030 and HsS78Bst.

For long-term, high-yield production of recombinant proteins, stable expression is preferred. For example, cell lines which stably express the express an anti-antigen antibody or the encoded polypeptides of the improved LAMP Construct may be engineered. Rather than using expression vectors which contain viral origins of replication, host cells can be transformed with a polynucleotide controlled by appropriate expression control elements (e.g., promoter, enhancer, sequences, transcription terminators, polyadenylation sites, etc.), and a selectable marker. Following the introduction of the foreign polynucleotide, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the anti-antigen antibody or the encoded polypeptides of the improved LAMP Construct.

A number of selection systems may be used, including but not limited to, the herpes simplex virus thymidine kinase (Wigler et al., Cell 11:223 (1977)), hypoxanthineguanine phosphoribosyltransferase (Szybalska & Szybalski, Proc. Natl. Acad. Sci. USA 48:202 (1992)), and adenine phosphoribosyltransferase (Lowy et al., Cell 22:8 17 (1980)) genes can be employed in tk−, hgprt− or aprt− cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 (Goldspiel et al., Clinical Pharmacy, 12: 488-505 (1993); Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62: 191-217 (1993); TIB TECH 11(5):155-215 (May; 1993)); and hygro, which confers resistance to hygromycin (Santerre et al., Gene 30:147 (1984)). Methods commonly known in the art of recombinant DNA technology may be routinely applied to select the desired recombinant clone, and such methods are described, for example; in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., J. Mol. Biol. 150:1 (1981).

The expression levels of either an anti-antigen antibody or the encoded polypeptides of the improved LAMP Construct can be increased by vector amplification (for a review, see Bebbington and Hentschel, *The Use Of Vectors Based On Gene Amplification For The Expression Of Cloned Genes In Mammalian Cells In DNA Cloning*, Vol. 3. (Academic Press, New York, 1987)). When a marker in the vector system expressing an anti-antigen antibody or the encoded polypeptides of the improved LAMP Construct is amplifiable, an increase in the level of inhibitor present in the host cell culture will increase the number of copies of the marker gene. Since the amplified region is associated with the coding sequence, production of the anti-antigen antibody express or the encoded polypeptides of the improved LAMP Construct will also increase (Crouse et al., Mol. Cell. Biol. 3:257 (1983)).

Other elements that can be included in vector sequences include heterologous signal peptides (secretion signals), membrane anchoring sequences, introns, alternative splice sites, translation start and stop signals, inteins, biotinylation sites and other sites promoting post-translational modifications, purification tags, sequences encoding fusions to other proteins or peptides, separate coding regions separated by internal ribosome reentry sites, sequences encoding "marker" proteins that, for example, confer selectability (e.g., antibiotic resistance) or sortability (e.g., fluorescence), modified nucleotides, and other known polynucleotide cis-acting features not limited to these examples.

The host cell may be co-transfected with two expression vectors of the invention, for example, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain is preferably placed before the heavy chain to avoid an excess of toxic free heavy chain (Proudfoot, Nature 322:52 (1986); Kohler, Proc. Natl. Acad. Sci. USA 77:2 197 (1980)). The coding sequences for the heavy and light chains may comprise cDNA or genomic DNA or synthetic DNA sequences.

Once an anti-antigen antibody or the encoded polypeptides of the improved LAMP Construct has been produced by recombinant expression, it may be purified by any method known in the art for purification of a protein, for example, by chromatography (e.g., ion exchange, affinity (particularly by Protein A affinity and immunoaffinity for the specific antigen), and sizing column chromatography), centrifugation, differential solubility, or by any other standard technique for the purification of proteins. Further, an anti-antigen antibody or the encoded polypeptides of the improved LAMP Construct may be fused to heterologous polypeptide sequences described herein or otherwise known in the art to facilitate purification.

In one example, the anti-antigen antibody or the encoded polypeptides of the improved LAMP Construct may be fused with the constant domain of immunoglobulins (IgA, IgE, IgG, IgM), or portions thereof (CH1, CH2, CH3, or any combination thereof and portions thereof), or albumin (including but not limited to recombinant human albumin or fragments or variants thereof (see, e.g., U.S. Pat. No. 5,876, 969, issued Mar. 2, 1999, EP Patent 0 413 622, and U.S. Pat. No. 5,766,883, issued Jun. 16, 1998), resulting in chimeric polypeptides. Such fusion proteins may facilitate purification and may increase half-life in vivo. This has been shown for chimeric proteins consisting of the first two domains of the human CD4-polypeptide and various domains of the constant regions of the heavy or light chains of mammalian immunoglobulins. See, e.g., EP 394,827; Traunecker et al., Nature, 331:84-86 (1988). Enhanced delivery of an antigen across the epithelial barrier to the immune system has been demonstrated for antigens (e.g., insulin) conjugated to an FcRn binding partner such as IgG or Fe fragments (see, e.g., PCT Publications WO 96/22024 and WO 99/04813). IgG Fusion proteins that have a disulfide-linked dimeric structure due to the IgG portion disulfide bonds have also been found to be more efficient in binding and neutralizing other molecules than monomeric polypeptides or fragments thereof alone. See, e.g., Fountoulakis et al., J. Biochem., 270:3958-3964 (1995). Nucleic acids encoding the anti-antigen antibody or the encoded polypeptides of the improved LAMP Construct described herein can also be recombined with a gene of interest as an epitope tag (e.g., the hemagglutinin ("HA") tag or flag tag) to aid in detection and purification of the expressed polypeptide. For example, a system described by Janknecht et al. allows for the ready purification of non-denatured fusion proteins expressed in human cell lines (Janknecht et al., 1991, Proc. Natl. Acad. Sci. USA 88:8972-897). In this system, the gene of interest is subcloned into a vaccinia recombination plasmid such that the open reading frame of the gene is translationally fused to an amino-terminal tag consisting of six histidine residues. The tag serves as a matrix-binding domain for the fusion protein. Extracts from cells infected with the recombinant vaccinia virus are loaded onto Ni2+ nitriloacetic acid-agarose column and histidine-tagged proteins can be selectively eluted with imidazole-containing buffers.

Administration

Vaccine material according to this invention may contain the immune stimulatory improved LAMP Constructs described herein or may be recombinant microorganisms, or antigen presenting cells which express the immune stimulatory improved LAMP Constructs. Preparation of improved LAMP Constructs containing vaccine material according to this invention and administration of such improved LAMP Constructs for immunization of individuals are accomplished according to principles of immunization that are well known to those skilled in the art.

Large quantities of these materials may be obtained by culturing recombinant or transformed cells containing replicons that express the improved LAMP Constructs described herein. Culturing methods are well-known to those skilled in the art and are taught in one or more of the documents cited above. The improved LAMP Construct vaccines are generally produced by culture of recombinant or transformed cells and formulated in a pharmacologically acceptable solution or suspension, which is usually a physiologically-compatible aqueous solution, or in coated tablets, tablets, capsules, suppositories or ampules, as described in the art, for example in U.S. Pat. No. 4,446,128, incorporated herein by reference. Administration may be any suitable route, including oral, rectal, intranasal or by injection where injection may be, for example, transdermal, subcutaneous, intramuscular or intravenous.

The improved LAMP Constructs are administered to a mammal in an amount sufficient to induce an immune response in the mammal. A minimum preferred amount for administration is the amount required to elicit antibody formation to a concentration at least 4 times that which existed prior to administration. A typical initial dose for administration would be 10-5000 micrograms when administered intravenously, intramuscularly or subcutaneously, or $10^5$ to $10^{11}$ plaque forming units of a recombinant vector, although this amount may be adjusted by a clinician doing the administration as commonly occurs in the administration of vaccines and other agents which induce immune responses. A single administration may usually be sufficient to induce immunity, but multiple administrations may be carried out to assure or boost the response.

The improved LAMP Construct vaccines may be tested initially in a non-human mammal (e.g., a mouse or primate). For example, assays of the immune responses of inoculated mice can be used to demonstrate greater antibody, T cell proliferation, and cytotoxic T cell responses to the improved LAMP Constructs than to wild type antigen. Improved LAMP Constructs can be evaluated in Rhesus monkeys to determine whether the vaccine formulation that is highly effective in mice will also elicit an appropriate monkey immune response. In one aspect, each monkey receives a total of 5 mg DNA per immunization, delivered IM and divided between 2 sites, with immunizations at day 0 and at weeks 4, 8, and 20, with additional doses optional. Antibody responses, ADCC, CD4+ and CD8+ T-cell cytokine production, CD4+ and CD8+ T-cell antigen-specific cytokine staining can be measured to monitor immune responses to the vaccine.

Further description of suitable methods of formulation and administration according to this invention may be found in U.S. Pat. No. 4,454,116 (constructs), U.S. Pat. No. 4,681,762 (recombinant bacteria), and U.S. Pat. Nos. 4,592,002 and 4,920,209 (recombinant viruses).

Cancer Immunotherapy: Candidates for Prevention and Treatment

The improved LAMP Constructs described herein comprising at least one cancer antigen described in Table 1 can be used to treat patients who have cancer and/or a hyperproliferative disorder. Examples include patients with documented Epstein-Barr virus associated lymphomas, patients with HPV associated cervical carcinomas, patients with chronic HCV, or patients with a defined re-arrangement or mutation in an oncogene or tumor suppressor gene. Further preferred embodiments include patients having hyperproliferative disorders, including cancer, resulting from CMV infection.

In preferred embodiments, cancers that can be treated using the improved LAMP Constructs described herein include, but are not limited to all stages of progression, including hyperplasia of an adenocarcinoma, sarcoma, skin cancer, melanoma, bladder cancer, brain cancer (including glioblastoma multiforme), breast cancer, uterine cancer, ovarian cancer, prostate cancer, lung cancer (including, but not limited to NSCLC, SCLC, squamous cell cancer), colorectal cancer, anal cancer, rectal cancer, cervical cancer, liver cancer, head and neck cancer, oral cancer, salivary gland cancer, esophageal cancer, pancreas cancer, pancreatic ductal adenocarcinoma (PDA), renal cancer, stomach cancer, kidney cancer, multiple myeloma or cerebral cancer.

It is envisioned that therapy with an improved LAMP Construct, such as in the case of a vaccine composition comprising the improved LAMP Construct, could be utilized at any period during the course of the individual's cancer, once it is identified. It is also possible that in high risk patients, vaccination in order to prevent the subsequent emergence of a cancer. Protein based LAMP Construct vaccines as well as cell therapy (e.g, dendritic cell therapy comprising LAMP Constructs) are also envisioned.

Procedure for Therapy

In one embodiment, the improved LAMP Constructs could be injected into the patient at any suitable time during the course of their malignancy. For example, the improved LAMP Construct comprising at least one cancer antigen described in Table 1 would be injected at a stage when the tumor burden was low. In an alternative embodiment in which the improved LAMP Construct is introduced into the individual's antigen presenting cells (such as, for example, dendritic cells), precursors to the antigen presenting cells or mature antigen presenting cells are drawn either from the individual's bone marrow or peripheral blood by vena puncture. These cells are established in culture followed by transduction with the improved LAMP Construct. Once transduction had occurred, these antigen presenting cells are injected back into the patient.

In a particularly preferred embodiment, the invention provides a method of treatment for a cancer patient having low tumor burden, such as early in the disease, after resection of a neoplastic tumor, or when the burden of tumor cells is otherwise reduced. In this method, a cell population containing autologous stem cells capable of differentiation into antigen presenting cells which will express MHC class II molecules is obtained from the patient. These cells are cultured and transformed by introducing an improved LAMP Construct to deliver the cancer antigen to be associated with an MHC class II molecule either within the compartment/organelle or within another compartment/organelle to which the antigen is delivered.

The transfected stem cell population is then reintroduced into the patient, where the stem cells differentiate into antigen presenting cells which express MHC class II molecules complexed with Th epitopes from the antigen. The immune response to the antigen will be enhanced by enhanced stimulation of the helper T cell population.

More generally, in one embodiment, this invention provides a vaccine composition comprising the improved LAMP Construct for modulating an immune response in a mammal to an antigen (i.e., stimulating, enhancing, or reducing such a response).

Kits

The invention further comprises kits to facilitate performing the methods described herein. In one aspect, a kit comprises an improved LAMP Construct as described herein and a cell for receiving the improved LAMP Construct. The kit may additionally comprise one or more nucleic acids for engineering the cell into a professional APC. In one aspect, however, the cell is a professional APC. The cell may or may not express co-stimulatory molecules. In a preferred aspect, when the cell does not express co-stimulatory molecules, the antigen encoded by the improved LAMP Construct is an autoantigen. In another aspect, a panel of cells is provided expressing different MHC molecules (e.g., known to be expressed in human beings). In a further aspect, the kit comprises reagents to facilitate entry of the improved LAMP Constructs into a cell (e.g., lipid-based formulations, viral packaging materials, cells, and the like). In still a further aspect, one or more T cell lines specific for the antigen encoded by the improved LAMP Construct is provided, to verify the ability of the improved LAMP Construct to elicit, modulate, or enhance an immune response.

EXAMPLES

The invention will now be further illustrated with reference to the following examples. It will be appreciated that what follows is by way of example only and that modifications to detail may be made while still falling within the scope of the invention.

Example 1—Construction of LAMP Constructs

The improved LAMP Constructs illustrated in FIG. 1 can be constructed using standard molecular biology techniques well known to the skilled artisan. For example, plasmids comprising the polynucleotides can be designed to generate the different structures ILC-1 to ILC-6 shown in FIG. 1. The LAMP domains illustrated in FIG. 1 can be derived from the amino acid sequences shown in FIGS. 3-10. Preferably the LAMP domains are derived from the human LAMP proteins shown in FIGS. 3-10. The boundaries of each domain can be derived from FIG. 2A and FIG. 2B. It is envisioned that the corresponding domains can also be cloned from the orthologous sequences by identifying the equivalent domains when compared to the human sequence. The cancer antigens can be cloned into the described LAMP Constructs either individually or in combination as described in Table 1.

Example 2—Immune Response Evaluation of Mice to LAMP Constructs

The ability of the improved LAMP Constructs as described in Example 1 can be tested for their ability to modulate an immune response. For example, Female BALB/c mice can be immunized i.d with 50 ug of the improved LAMP Constructs and 5 ug of GMCSF in 100 ul PBS using nanopass on day 0, 14 and 28. Experiment will then be terminated 4 weeks after the last dose.

Splenocytes (3×105/well) are stimulated with antigenic protein (10 ug/ml) in T cell media (RPMI with 10% heat inactivated FBS, 1% penicillin/streptomycin, and 1×2-ME), supernatants are collected 72 h after. Supernatants are diluted (400 ul supernatant+200 ul T cell media) and cytokines are evaluated by ELISA. IL-10 or IL-4 production can be measured via ELISPOT assay.

Example 3—Improved Antigen Presentation Using LAMP Constructs

Survivin is the smallest member of the Inhibitor of Apoptosis (IAP) family of proteins, involved in inhibition of apoptosis and regulation of cell cycle. These functional attributes make Survivin a unique protein exhibiting divergent functions i.e. regulating cell proliferation and cell death. Expression of Survivin in tumors correlates with not only inhibition of apoptosis and a decreased rate of cell death, but also resistance to chemotherapy and aggressiveness of tumors [1-6]. Therefore, Survivin is an important target for cancer vaccines and therapeutics [7-9]. Survivin has also been found to be prominently expressed on both human and embryonic stem cells and many somatic stem cell types indicating its yet unexplored role in stem cell generation and maintenance.

Cancer is a heterogeneous group of diseases where abnormal cell growth with potential to invade other body parts takes control of normal homeostasis and becomes fatal if not timely and rightly treated. Immunotherapy specifically targets tumor cells thereby avoiding collateral damage to non-tumor cells and inducing anti-tumor response. This anti-tumor response also has the potential to eradicate tumor at distant sites in the body which may not be possible by surgical resection. Induction or enhancement of anti-tumor immune response is a formidable challenge in cancer because tumor cells use multiple evasion strategies and avoid being detected or eliminated by immune cells.

The aim of this project is to evaluate in vivo immune response of all new generation of LAMP Constructs injected by I.D. in BALB/c mice. Specifically, mice were immunized with 50 μg of the tested constructs defined in the legend of FIG. 1 by intradermal injection. No adjuvants were added at this experiment. Six mice per group were administrated with vaccines every 7 days with total three dose in one month. Immune response was monitored 14 days after the last immunization.

The tested LAMP constructs were generated as described herein and the sequence of each tested construct is shown in FIG. 19. Survivin protein was purchased from MyBiosource (San Diego, CA). Survivin peptides were from GenScript (Piscataway, NJ). Anti-survivin and m-IgGk-BP-HRP were bought from Santa Cruz Biotechnology (Dallas, TX), and mouse Monoclonal anti-LAMP-1/CD107a were from OriGene Technologies (Rockville, MD). ELISPOT antibody pairs for IFNγ were from Biolegend. Fluorescently coupled CD3, CD4, CD8, CD44, CD62L, IFNγ, TNFα, granzyme B, CD69 monoclonal antibodies and Zombie aqua fixable viability kit were purchased from BioLegend (San Diego, CA). Goat anti-mouse IgG2a-HRP and goat anti-mouse IgG-HRP were purchased from Southern Biotechnologies (Birmingham, AL). Streptavidin-HRP was purchased from Thermo Fisher (Waltham, MA). SureBlue TMB microwell peroxidase substrate and TMB stop solution were purchased from KPI. (Gaithersburg, MD).

50 μg of each construct was used in a total volume of 100 ul per mouse per dose for PHARMAJET®. Mice were immunized with the vaccine by i.d. delivery on days 0, 7, and 14. Mice were bled on days 28 for serum collection. Serum was collected and stored in −30° C. Spleens were collected on day 28 at the termination of experiment and processed for ELISPOT and FACS to evaluate survivin specific T cell responses.

Measurement of plasma survivin-specific total IgG by ELISA. The murine antibody response to survivin was assessed by indirect ELISA. ELISA plates (MaxiSorp) were coated with 2 μg/ml survivin (1-142) protein in carbonate-bicarbonate buffer overnight and then blocked with 2% BSA in PBS. Plasma samples were diluted 1:100 in blocking buffer. Samples were detected with goat anti-mouse IgG-HRP (Southern Biotech, Birmingham, AL). Reaction was developed with SureBlue TMB Substrate and stopped with TMB Stop Solution from KPL (Gaithersburg, MD). Plates were read (OD450) by using Epoch ELISA reader (BioTek, Winooski, VT).

Evaluation of antigen-specific T cell response. To assess antigen-specific T cell response in the vaccinated mice, splenocytes from vaccinated mice were evaluated for antigen-specific IFNγ production by Enzyme-linked immunospot (ELISPOT). For ELISPOT assays, 96-well nitrocellulose plates (Millipore), were coated overnight at 4° C. with 100 μl/well of capture monoclonal antibody in PBS. The plates were washed three times with 200 μl/well PBS and blocked with 200 μl/well T cell media for at least 2 hrs at room temperature. Splenocytes were plated at 3×10$^5$ cells/well and co-cultured with 2 μg/ml pooled peptides of Survivin (Table 2) or concavalin A (0.125 μg/ml) or medium alone in a total volume of 200 μl/well T cell media (RPMI-1640 with L-Glutamine and HEPES (ATCC), 1% penicillin, 1% streptomycin, and 5×10$^{-5}$M β-ME) at 3×10$^5$ cells/well for 48 h at 37° C. in 5% $CO_2$. The plates were washed two times with 200 μl/well PBS and two times with 200 μl/well PBS-T (0.05% Tween/PBS). Diluted detection antibodies (50 μl/well in PBS-T/0.5% BSA) were added and plates were incubated for 2 hrs with shaking at room temperature. Plates were washed four times with PBS. Streptavidin-alkaline phosphatase diluted in PBS (50 μl/well) were added and incubated for 2 h. Plates were washed with PBS four times and developed with 50 μl/well of 3-Amino-9-Ethyl-carbazole (AEC, BD Bioscience) substrate for 10 min. Color development was stopped by washing under running tap water. After drying 72 h at room temperature in dark, colored spots were counted using an AID ELISPOT High-Resolution Reader System and AID ELISPOT Software version 3.5 (Autoimmun Diagnostika GmbH).

TABLE 2

Pooled peptides from Genscript

| Pooled P1 | Sur1-15, Sur11-25, Sur 21-35, Sur31-45, sur 41-55 |
| Pooled P2 | Sur51-65, sur61-75, sur71-85, sur81-95 |
| Pooled P3 | Sur91-105, sur 101-115, sur111-125, sur121-135, sur131-142 |
| Pooled P4 | Sur31-45, sur41-55 and sur51-65 |

Western blots. 293T cells were transfected with the tested constructs using lipofectamine 2000 reagents (Invitrogen). Transfected cells were washed with PBS and suspended in 200 µl of RIPA lysis buffer with halt proteinase inhibitors (Thermo Scientific, Waltham, MA). Lysates were centrifuges (700 g for 15 minutes at 4° C.), followed by measurement of protein concentration in the clarified supernatants using Pierce BCA protein Assay kit (ThermoFisher Scientific, Waltham, MA). 10 µg of protein was electrophoresed in pre-cast (4-20%) SDS-PAGE gels (BioRad, Hercules, California), and transferred onto nitrocellulose membranes (BioRad) and immunoblotted with mAbs to hLAMP. Membranes were blocked with Detection™ block buffer (KPL) and probed with rabbit anti-human LAMP (Sino Biological Inc., Beijing, China) or anti-survivin antibody and goat anti-rabbit-HRP antibody, and then developed with TMB (KPL).

Flow cytometry. Cells were first labelled with Zombie aqua fixable viability dye in PBS (1:500 dilution), followed by surface antibodies (1:100 dilution) in staining buffer (4% FBS, 2% rat serum, 2% mouse serum in PBS). For intracellular staining cells were stained with Zombie aqua, followed by surface staining, fixation with 4% paraformaldehyde, and stained with intracellular antibody in permeabilization buffer (PBS with 1% FCS 0.1% saponin). Samples were analyzed on a CytoFlex flow cytometer (Beckman Coulter) and analyzed using Kaluza software (Beckman Coulter).

Statistics. Two-Way ANOVA test was performed using GraphPad Prism 6.0 software or R file to evaluate the statistical significance. Each mouse's RPMI result was deducted from the results of the antigen activation.

Vaccines, and immunizations. Control, Survivin+Complete LAMP, Survivin-ILC-1 Construct, Survivin-ILC-2, Survivin-ILC-3, and Survivin-ILC-4 Construct vaccines were used in a total volume of 25 µl per mouse per dose. Mice were immunized with the vaccine by ID delivery on days 0, 7, and 14. Mice were bled on days-13, and 28 for serum collection. Serum was collected and stored in −30° C. Spleens were collected on day 28 and processed for ELISPOT/ELISA assays.

Figure 14:
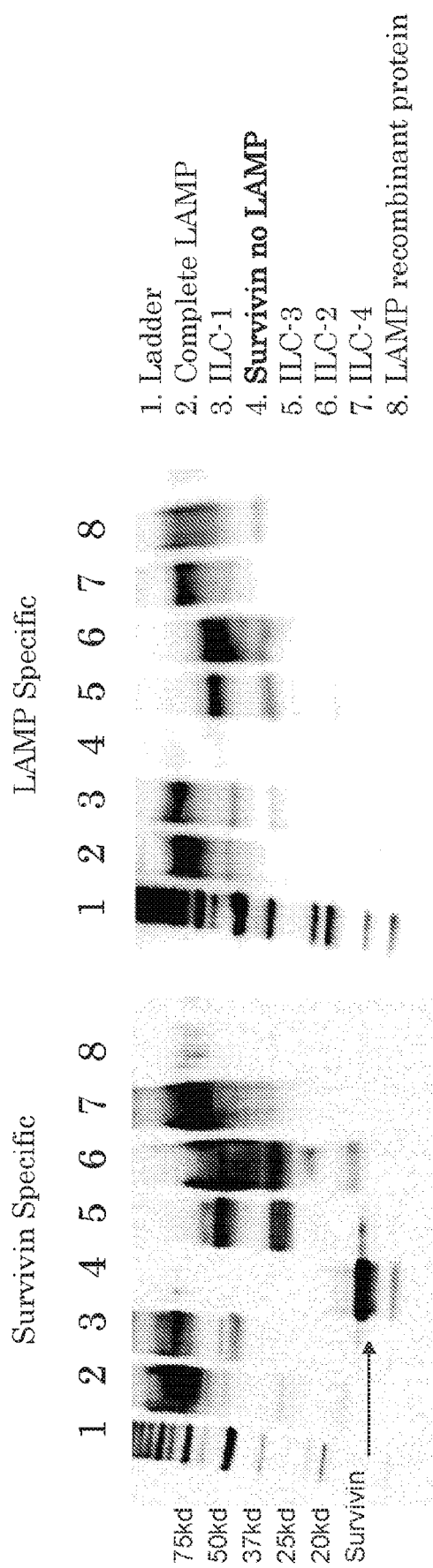
FIG. 14 confirms protein expression of tested improved LAMP Constructs. In each of FIGS. 14

FIG. 14: Validation of the plasmids: 293T cells were transfected with the plasmids for 3 days. Transfected cells were lysed, and then electrophoresed in pre-cast SDS-PAGE gel. The proteins were transferred to nitrocellulose membranes and immunoblotted with mAbs to human LAMP (OriGene, #TA337108) or survivin Santa Cruz #17779). Molecular weight of LAMP=100 KD, Survivin=16 KD. FIG. 13 shows that all tested LAMP constructs produced appropriately sized protein.

Figure 15:
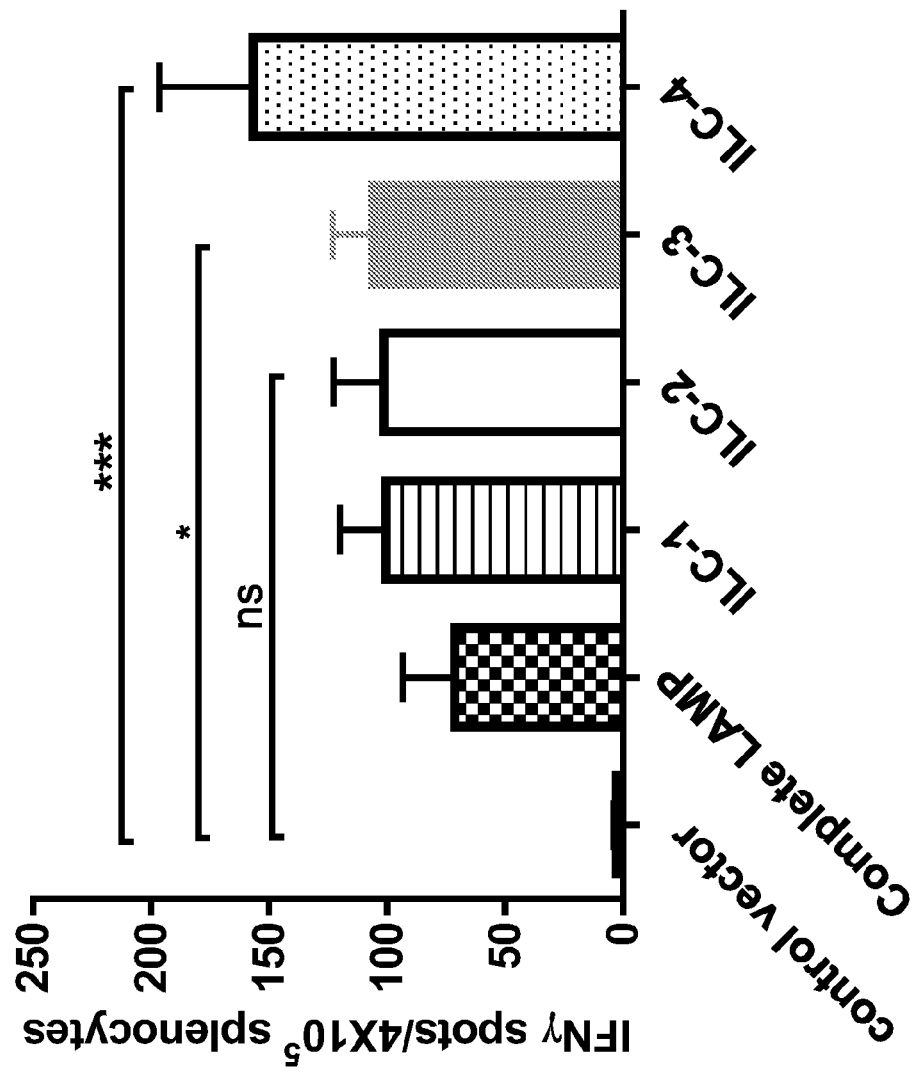
Figure 16:
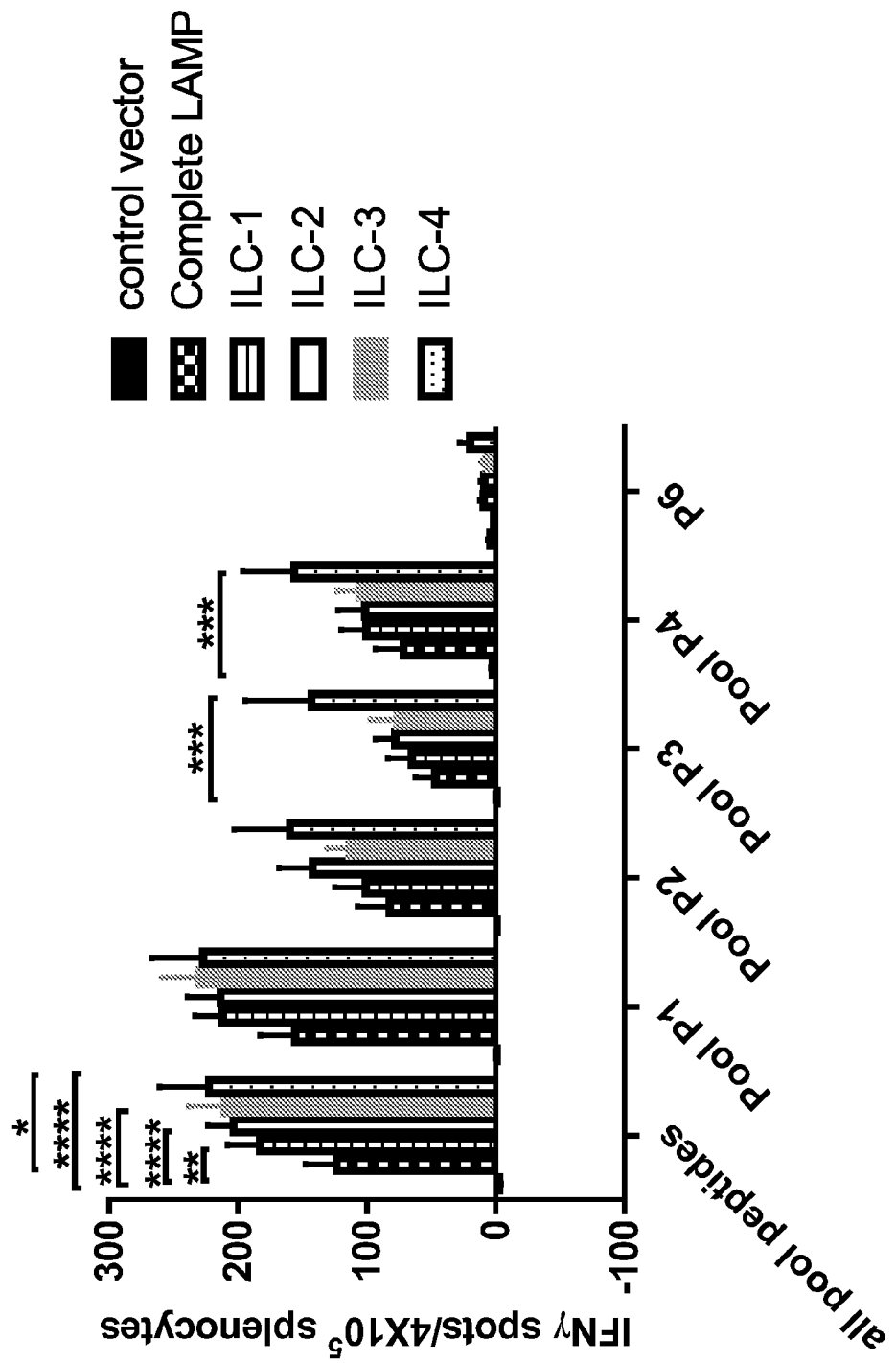

FIGS. 15 and 16: Tested LAMP Constructs induce Th1 effector T cells producing IFNγ. Female BALB/c mice were immunized i.d with 50 µg of the indicated constructs in 100 µl PBS via PHARMAJET® device on day 0, 7 and 14. Experiment was terminated 14 days after the last dose. Splenocytes ($3 \times 10^5$/well) were stimulated with survivin pooled peptides (4 µg/ml) in T cell media (RPMI with 10% heat inactivated FBS, 1% penicillin/streptomycin, and 1× β-ME), for 48 h. A. IFNγ production by spots. B. IFNγ production induced by all pooled peptides (bar figure from A). n=6 per group. Two way ANOVA (R file) was used for statistical analysis. FIG. 14 shows that all tested LAMP constructs induced a robust T cell response as shown by IFNγ production.

Figure 17:
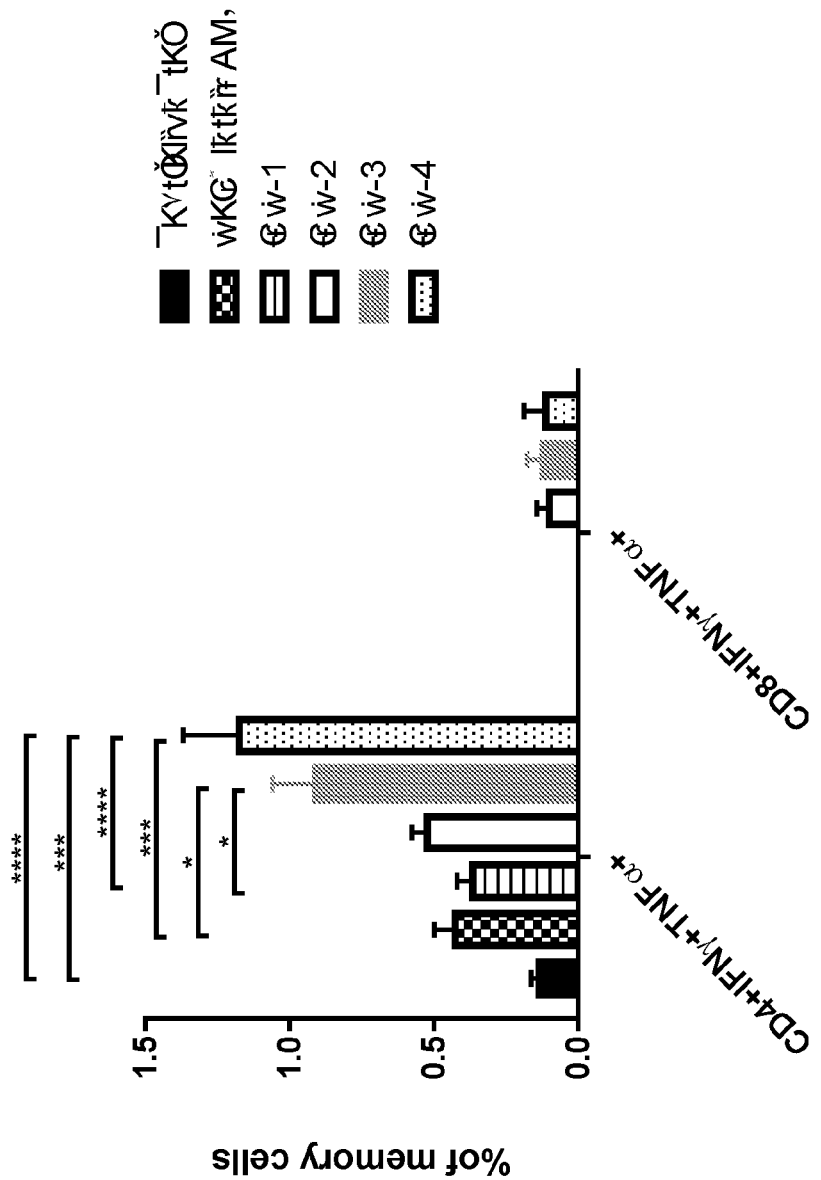

We unexpectedly found that after 3 dose of the improved LAMP Constructs (one week apart), a robust Th1 type response elicited by tested LAMP Constructs, especially ILC-4 where the hinge sequence was replaced by Survivin gene. More interestingly, improved LAMP Construct ILC-4 appears to recognize the Survivin epitopes from N-terminal to C-terminal, and induce T cell response against human Survivin peptide sequence which is 100% identical to the mouse. We also found longer (72 hrs) stimulation of frozen-thawed splenocyte cells with Survivin peptides, ILC-4 showed significant higher IFNγ production than the first generation of LAMP-Survivin (see FIG. 19). Specifically, FIG. 16 shows that the all improved LAMP Constructs tested showed higher T cell response with ILC-4 having the best activity as this constructed elicited a significantly higher T cell response against all Survivin peptides pools. Moreover, contrary to what was known in the art, removal of the second homology domain of the luminal domain created an improved LAMP construct that elicited a more robust immune response as compared to the complete LAMP construct (see, results for ILC-2 and ILC-3). Frozen splenocytes ($4 \times 10^5$/well) were stimulated with pooled peptides 4 (4 µg/ml) in T cell media (RPMI with 10% heat inactivated FBS, 1% penicillin/streptomycin, and 1× β-ME), for 48 h. n=6 per group. Two way ANOVA was used for statistical analysis. *$p<0.05$, $p<0.01$, *$p<0.005$, **$p<0.0001$ FIG. 17**. CD4 T cells are the major source of IFNγ producing cells. Female BALB/c mice were immunized i.d with 50 µg of the indicated vaccines in 100 µl PBS via PHARMAJET® device on day 0, 7 and 14. Experiment was terminated 14 days after the last dose. Splenocytes ($1 \times 10^6$/well) were stimulated with pooled peptides 1 (4 µg/ml) in T cell media (RPMI with 10% heat inactivated FBS, 1% penicillin/streptomycin, and 1× β-ME) over night, followed by adding monesin and brefeldin A and culturing for additional 5h. Cells were harvested and stained by Zombie, surface marker, and intracellular staining according to ITI staining protocol. Cells are gated on memory CD4 T cells (CD4+CD44+CD62L−) or CD8 T cells (CD8+CD44+CD62L−). Data is representative of one mouse in each group. While there is an increase in CD8 effector memory cells in vaccinated mice with the various constructs, IFNγ production is more pronounced in the CD4 T cell population.

Figure 18:
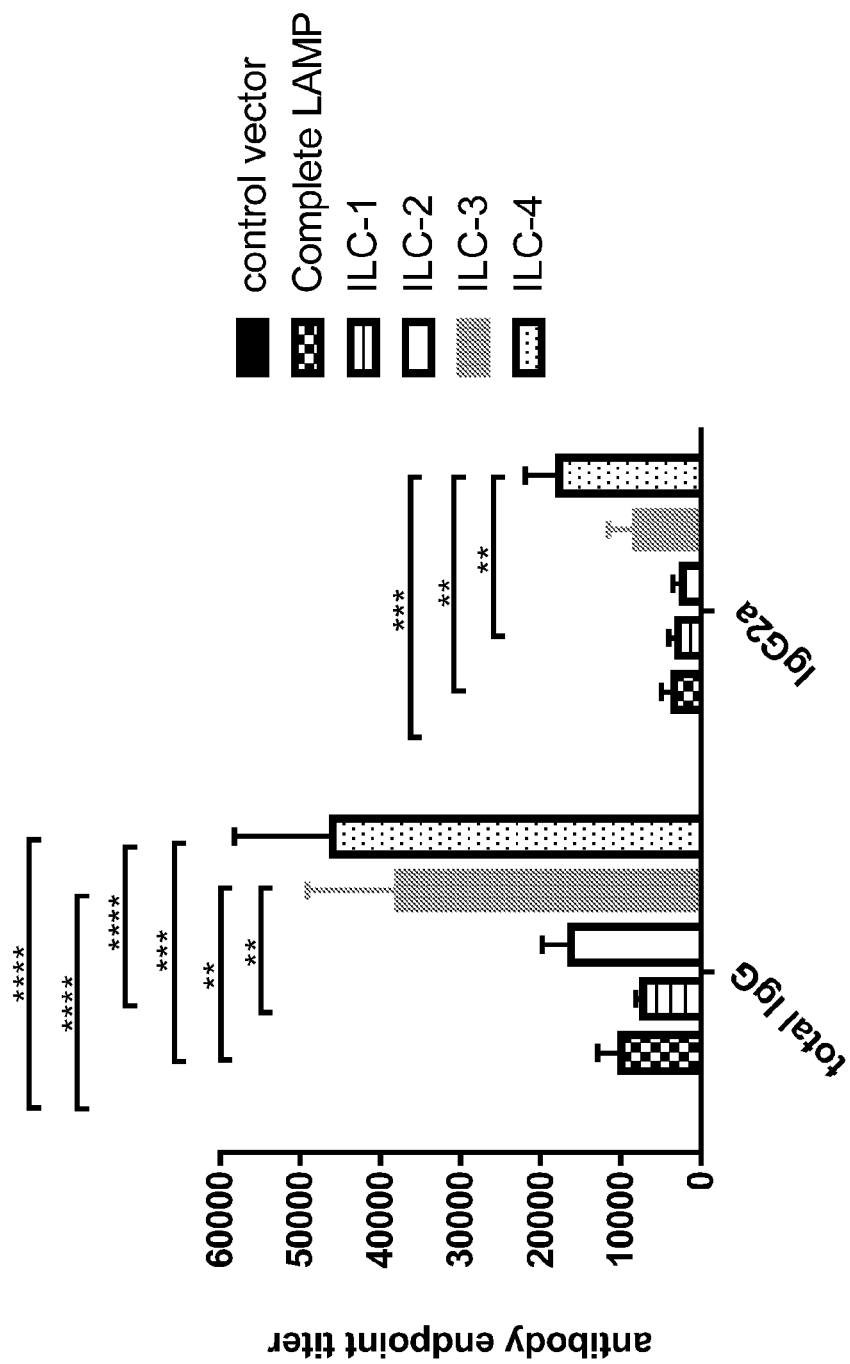

FIG. 18: Improved LAMP Constructs produced stronger Survivin-specific total IgG response in BALB/c mice. Female BALB/c mice were immunized i.d with 50 µg of the indicated vaccines in 100 µl PBS via PHARMAJET® device on day 0, 7 and 14. Experiment was terminated 14 days after the last dose. Mice were bleed on days 28. Serum was separated and stored in −30° C. Total IgG and IgG2a were determined in serum by ELISA. Briefly, ELISA plates were coated with 2 µg/ml Survivin (1-142aa), blocked with PBS/2% BSA, serum (1:100 dilution in blocking buffer) were evaluated by HRP-conjugated goat anti mouse IgG (1:6000) and IgG2a (1:11000). n=6 mice per group. $p<0.01$, *$p<0.005$, **$p<0.0001$. Importantly and contrary to what was known in the art, FIG. 18** shows that fragments of the luminal domain worked better than use of the complete luminal domain (i.e., compare complete LAMP construct with constructs ILC-2 and IL-3). Unexpectedly, insertion of the antigen between the two homology domains of the luminal domain generated the strongest antibody response (see, ILC-4).

REFERENCES RELIED ON IN THIS SECTION

1. Kami K, Doi R, Koizumi M, Toyoda E, Mori T, Ito D, et al. Survivin expression is a prognostic marker in pancreatic cancer patients. Surgery. 2004; 136(2):443-8. doi: 10.1016/j.surg.2004.05.023. PubMed PMID: 15300213.
2. Zhang S Q, Qiang S Y, Yang W B, Jiang J T, Ji Z Z. [Expression of survivin in different stages of carcinogenesis and progression of breast cancer]. Ai Zheng. 2004; 23(6):697-700. PubMed PMID: 15191674.
3. Zhang X, Zhong L, Hu K, Li Q. [Expression of survivin and its correlation with apoptosis in non-small cell lung cancer]. Zhongguo Fei Ai Za Zhi. 2004; 7(2):138-41. doi: 10.3779/j.issn.1009-3419.2004.02.14. PubMed PMID: 21215009.
4. Kishi H, Igawa M, Kikuno N, Yoshino T, Urakami S, Shiina H. Expression of the survivin gene in prostate cancer: correlation with clinicopathological characteristics, proliferative activity and apoptosis. J Urol. 2004; 171(5):1855-60. doi: 10.1097/01.ju.0000120317.88372.03. PubMed PMID: 15076293.
5. Asanuma K, Tsuji N, Endoh T, Yagihashi A, Watanabe N. Survivin enhances Fas ligand expression via up-regulation of specificity protein 1-mediated gene transcription in colon cancer cells. J Immunol. 2004; 172(6):3922-9. PubMed PMID: 15004200.
6. Miyachi K, Sasaki K, Onodera S, Taguchi T, Nagamachi M, Kaneko H, et al. Correlation between survivin mRNA expression and lymph node metastasis in gastric cancer. Gastric Cancer. 2003; 6(4):217-24. doi: 10.1007/s10120-003-0255-2. PubMed PMID: 14716515.
7. Badana A K, Chintala M, Gavara M M, Naik S, Kumari S, Kappala V R, et al. Lipid rafts disruption induces apoptosis by attenuating expression of LRP6 and survivin in triple negative breast cancer. Biomed Pharmacother. 2017; 97:359-68. doi: 10.1016/j.biopha.2017.10.045. PubMed PMID: 29091885.
8. Cai J P, Wang Y D, Zhang X, Xue H Z. [Expression of P16 and survivin in liver cancer and their clinical significance]. Zhonghua Gan Zang Bing Za Zhi. 2017; 25(10):778-80. doi: 10.3760/cma.j.issn.1007-3418.2017.10.013. PubMed PMID: 29108210.
9. Cho H J, Kim H R, Park Y S, Kim Y H, Kim D K, Park S I. Prognostic value of survivin expression in stage III non-small cell lung cancer patients treated with platinum-based therapy. Surg Oncol. 2015; 24(4):329-34. doi: 10.1016/j.suronc.2015.09.001. PubMed PMID: 26690822.
10. Godinho R M, Matassoli F L, Lucas C G, Rigato P O, Goncalves J L, Sato M N, et al. Regulation of HIV-Gag expression and targeting to the endolysosomal/secretory pathway by the luminal domain of lysosomal-associated membrane protein (LAMP-1) enhance Gag-specific immune response. PLoS One. 2014; 9(6):e99887. doi: 10.1371/journal.pone.0099887. PubMed PMID: 24932692; PubMed Central PMCID: PMCPMC4059647.

Example 4: Therapeutic Treatment of LAMP Constructs

Female BALB/c mice can be inoculated s.c with syngeneic 7000 4T1 mammary carcinoma cells on day 0. Vaccine 50 ug and 5 ug of GMCSF in 100 ul PBS is given i.d using nanopass once the tumors are palpable. Primary tumors are measured with a caliper and tumor volume is calculated using the formula p/6 (length×width)3/2. Average tumor volume as a function of days after tumor inoculation can be measured. A Kaplan-Meier plot can be used to show overall survival at the point of termination.

Example 5—Prime/Boost Protocol

Herpesvirus entry mediator (HVEM), also known as tumor necrosis factor receptor superfamily member 14 (TNFRSF14) or CD270, is a human cell surface receptor of the TNF-receptor superfamily. In recent years, HVEM has been found highly expressed on hematopoietic cells and a variety of parenchymal cells, such as breast, melanoma, colorectal, and ovarian cancer cells, as well as gut epithelium. HVEM is a bidirectional protein, either inhibiting or stimulating T cells, through binding to BTLA or LIGHT (TNFSF14).

We generated a DNA vaccine encoding HVEM-LAMP to generate an antibody which could block the inhibitory function of HVEM for tumor therapeutic applications. We hypothesized that LAMP will promote the antibody response by enhancing the affinity of HVEM specific antibodies and/or expanding the repertoire of B cell epitopes in the HVEM protein. In this study, we compared the immunogenicity of HVEM encoding plasmid with and without LAMP (SEQ ID NO: 158 and SEQ ID NO:159). Plasmids encoding HVEM-LAMP and HVEM and recombinant HVEM protein were designed as described herein.

Goat anti-mouse IgG-HRP was purchased from Southern Biotechnologies (Birmingham, AL). SureBlue TMB microwell peroxidase substrate and TMB stop solution were purchased from KPL (Gaithersburg, MD). ELISPOT plates were ordered from EMD Millipore (Billerica, MA, Cat. No. MAIPS4510). IFN-γ antibody pair used in ELISPOT was purchased from BioLegend (San Diego, CA) and clones AN18 and R46A2 were used as coating and detection, respectively. Streptavidin-HRP and AEC substrate were purchased from BD Biosciences (San Jose, CA).

Six to eight week old female Balb/c mice were purchased from Harlan Laboratories (Frederick, MA) and maintained at animal facility in Immunomic Therapeutics, Inc. (Rockville, MA). Mice (n=6) were treated with 10 μg/dose of HVEM-LAMP, HVEM, or LAMP vector control by electroporation IM delivery at days 0, 7, and 14. On day 35, mice were boosted with 5 μg HVEM protein in the presence of Alum by i.p. injection. On day 28 and 49, mice were bled and sera were isolated for antibody detection. Mice were sacrificed on day 56 and splenocytes were tested for IFN-γ production by ELISPOT.

ELISA procedure was followed by Su et al., J of Immunol Res; (10):1-15 (2016). Plates were coated with 5 μg/ml HVEM protein. Data were analyzed by using Microsoft Excel and Prism 6 software.

The primary aim of this study was to compare the antibody profiles between HVEM-LAMP and HVEM. On day 28, HVEM-LAMP vaccinated mice produced significant higher level of HVEM specific IgG antibody than that of the HVEM group (FIG. 11). After a protein boost, the HVEM specific antibody was increased about 1000-fold in HVEM immunized mice and the mean titer was changed from 100 to 108000. This result indicates that the immune memory was induced by the HVEM DNA plasmid. Although HVEM DNA alone only induced a minimal antibody response, protein boost rapidly recalled the immune memory. On the other hand, HVEM-LAMP group again exhibited a significant higher titer than the HVEM and LAMP groups, the mean titer is 5 folds of the HVEM group, indicating the power of LAMP in enhancing antibody response (FIG. 12).

Additionally serum samples (Day 49) from HVEM+ LAMP or HVEM alone immunized/HVEM protein boosted mice were pooled and tested for peptide mapping. Twelve peptides were found to be bound to the pooled serum (mouse IgG reaction) and seven of the twelve peptides showed strong binding affinity. HVEM+LAMP alters the binding affinity of peptides 17, 24, 25, and 28 as compared to HVEM alone as shown in FIG. 13. These changes may have physiological effects in protecting tumor growth.

In conclusion, data from this study suggest that two constructs were expressed in vivo and LAMP significantly improved the humoral immune response.

Example 6: Production of an Antibody from a Polypeptide

Anti-antigen antibodies can be prepared by a variety of standard methods of raising antibodies using animal injection. (See, Current Protocols, Chapter 2.) For example, cells expressing an improved LAMP Construct comprising a cancer antigen described herein is administered to a non-human vertebrate to induce the production of sera containing polyclonal antibodies. In a preferred method, a preparation of the LAMP/antigen protein is prepared and purified to render it substantially free of natural contaminants. Such a preparation is then introduced into the non-human vertebrate to produce polyclonal antisera of greater specific activity.

In the most preferred method, the anti-antigen antibodies of the present invention are monoclonal antibodies (or protein binding fragments thereof). Such monoclonal antibodies can be prepared using hybridoma technology. (Kohler et al., Nature 256:495 (1975); Kohler et al., Eur. J. Immunol. 6:511 (1976); Kohler et al., Eur. J. Immunol. 6:292 (1976); Hammerling et al., in: Monoclonal Antibodies and T-Cell Hybridomas, Elsevier, N.Y., pp. 563-681 (1981).) In general, such procedures involve immunizing a non-human vertebrate animal (preferably a rabbit, mouse, cow, camel, llama) with an improved LAMP Construct comprising an antigen, the encoded polypeptide of an improved LAMP Construct comprising an antigen or, more preferably, with an improved LAMP Construct-expressing cell. Such cells may be cultured in any suitable tissue culture medium; however, it is preferable to culture cells in Earle's modified Eagle's medium supplemented with 10% fetal bovine serum (inactivated at about 56 degrees C.), and supplemented with about 10 g/l of nonessential amino acids, about 1,000 U/ml of penicillin, and about 100 ug/ml of streptomycin.

The splenocytes of such non-human vertebrate host (e.g, mice) are extracted and fused with a suitable myeloma cell line. Any suitable myeloma cell line may be employed in accordance with the present invention; however, it is preferable to employ the parent myeloma cell line (SP20), available from the ATCC™. After fusion, the resulting hybridoma cells are selectively maintained in HAT medium, and then cloned by limiting dilution as described by Wands et al. (Gastroenterology 80:225-232 (1981).) The hybridoma cells obtained through such a selection are then assayed to identify clones which secrete antibodies capable of binding the antigen.

It will be appreciated that Fab and F(ab')2 and other fragments of the anti-antigen antibodies may be used according to the methods disclosed herein. Such fragments are typically produced by proteolytic cleavage, using enzymes such as papain (to produce Fab fragments) or pepsin (to produce F(ab')2 fragments). Alternatively, secreted protein-binding fragments can be produced through the application of recombinant DNA technology or through synthetic chemistry.

For in vivo use of antibodies in humans, it may be preferable to use "humanized" chimeric monoclonal antibodies. Such antibodies can be produced using genetic constructs derived from hybridoma cells producing the monoclonal antibodies described above. Methods for producing chimeric antibodies are known in the art. (See, for review, Morrison, Science 229:1202 (1985); Oi et al., Bio-Techniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).)

Example 7: Use of Polynucleotides to Generate Polyclonal and Monoclonal Antibodies Methods of directly injecting polynucleotides into animals are well described in the art. See, for example, U.S. Pat. Nos. 5,676,954; 6,875,748; 5,661,133. For example, a polynucleotide encoding an improved LAMP Construct comprising an antigen can be injected into the quadriceps muscles of restrained awake mice (female 6-12 week old BALB/c or Nude, nu/nu, from Harlan Sprague Dawley, Indianapolis, Ind.). In one embodiment, 50 µg of a polynucleotide in 50 µl solution using a disposable sterile, plastic insulin syringe and 28 G ½ needle (Becton-Dickinson, Franklin Lakes, N.J., Cat. No. 329430) fitted with a plastic collar cut from a micropipette tip can be used to inject the mice, as described in Hartikka, J., et al., Hum. Gene Ther. 7:1205-1217 (1996)).

Alternatively, 6-week old Sprague Dawley female mice (body weight 20-25 grams) can be given 5000 ppm ZnOSO4 in their drinking water beginning 24 hours prior to injection. This amount of zinc has been shown to be able to activate the metallothionein promoter. Each mouse is then injected intravenously through a tail vein puncture with a 25 gauge needle with 30 µg of a polynucleotide encoding an improved LAMP Construct comprising an antigen complexed with 150 µg liposome (Lipofection™) in a total volume of 30 µl. Animal care should be maintained throughout the study and should be performed in compliance with the "Guide for the Use and Care of Laboratory Animals", Institute of Laboratory Animal Resources, Commission on Life Sciences, National Research Council, National Academy Press.

After the injected polynucleotide encoding the improved LAMP Construct comprising an antigen is delivered into the cells in the animal, the antigen is delivered to the endosome/lysosome, processed and presented to the immune system. The improved LAMP Construct comprising an antigen can then stimulate the production of antibodies specific to the antigen. These antibodies can be isolated and used as a polyclonal mixture or further isolated into single species or monoclonals. The process of the immune response and production of antibodies against foreign antigens in vivo are well known in the art.

In a third animal model, Balb/c 3T3 A31 cells are transfected by electroporation with a polynucleotide encoding an improved LAMP Construct comprising an antigen. G418 resistant clones expressing LAMP Construct comprising an antigen are identified by their ability to bind human RBC. To generate polyclonal antibodies, Balb/c mice are immunized twice intraperitoneally, at an interval of 14 days, with $10^7$ cells comprising the improved LAMP Construct comprising an antigen. After a final boost, the immune serum is collected, IgG is purified by protein G Sepharose and passed over an antigen column prepared by coupling 1.0 mg purified antigen to cyanogen bromide activated Sepharose CL-4B. Bound IgG can be eluted with 0.1 M glycine buffer pH 2.5 and neutralized with 0.1 volumes of 0.1 M Tris pH 8.0. To generate a monoclonal antibody (mAb), Balb/c mice are immunized with LAMP Construct comprising an antigen and hybridomas are generated by fusing immune spleen cells with the SP2 myeloma following standard methods (28). A positive well reacting specifically with an antigen can be identified by enzyme-linked immunosorbent assays as described in the art. The hybridoma is cloned three times by limiting dilution to produce an antibody.

Example 8: Immunization of an Improved LAMP Construct Comprising an Antigen

Methods of raising antibodies in mammals are well known in the art. In one example, polyclonal antiscrum against a LAMP Construct comprising an antigen is raised by immunization of pathogen free rabbits with a total of 500 μg of an improved LAMP Construct comprising an antigen over a period of two months. For example, the improved LAMP Construct comprising an antigen can be dissolved in PBS and emulsified with an equal volume of Freund's adjuvant. After the final booster, the serum of the rabbits can be separated to determine the titer of the polyclonal antiserum.

In an additional animal model, groups of 5 mice (C57BL/6J; Jackson Labs) can be subcutaneously immunized with 5 μg of endotoxin-free LAMP Construct comprising an antigen emulsified in alum. Three weeks later, mice are bled and the presence of anti-antigen specific antibodies can be determined by titering the seras by ELISA (direct binding of antibodies in sera to wild type BPTI or APP-KI coated, directly or indirectly (via a biotinylated tag and streptavidin), on the wells).

To obtain monoclonal antibodies, 4-6 week old Balb/c mice can be immunized with an improved LAMP Construct comprising an antigen (for example 4 times with 2 week intervals with 10-100 μg/injection dissolved in Freunds complete adjuvant for the first injection, and Freund's incomplete adjuvant for subsequent immunizations). Splenocytes are isolated and fused with a fusion cell line such as Sp2/0 myeloma cells, followed by limiting dilution. Growing clones are screened using for example an enzyme-linked immunosorbant assay (ELISA). 96 cells plates are coated with an improved LAMP Construct comprising an antigen or with a control protein. The culture supernatant is added, followed by washing and addition of a labeled anti-mouse antibody for detection. After limited dilution cloning of the anti-antigen antibody producing stable hybridomas are obtained. From each cell, supernatant is collected and by affinity chromatography using protein A sepharose columns monoclonal antibodies can be purified.

Example 9—LAMP Constructs with IGFBP-2

Cancer vaccine development has been pursued for more than 4 decades. However, despite numerous clinical studies of a variety of cancer vaccine formulations, therapeutic cancer vaccination has had overall clinical benefit of about 20%[1, 2, 3, 4, 5]. Obstacles to improve efficacy have included a) poor immunogenicity of self-proteins that are cancer associated antigens, b) induction of regulatory T cells[6], and c) low immune response obtained by vaccination. Recent reports suggest a correlation of vaccine-induced Th1 immune infiltrate in tumor microenvironment with improved clinical response in many tumors[7, 8, 9, 10, 11].

Insulin-like growth factor binding protein 2 (IGFBP-2) is a self-protein elevated during progression of many human tumors. IGFBP-2 overexpression is correlated with high-grade gliomas with poor prognosis[12] and is an independent indicator of malignancy in breast cancer patients[13]. IGFBP2 is associated with metastasis and poor survival in lung cancer patients[14]. IGFBP2 overexpression is also correlated with advanced disease in adrenal cancer[15], bladder cancer[16], gastric cancer[17], ovarian cancer[18, 19], and prostrate cancer[20, 21].

Materials and Methods

Mice. Six to eight week old female C57BL/6 albino mice were purchased from Envigo and maintained at animal facility in Immunomic Therapeutics, Inc. (Rockville, MA).

Reagents and antibodies. Control vector Control, IGFBP2 (1-328)-no LAMP, and IGFBP2 (39-328)-ILC-1 Construct were made as described herein using standard protocols. Anti-mouse rabbit IGFBP2 PoAb was from MyBiosource (San Diego, CA), goat anti-rabbit IgG-FITC was from e-biosciences (San Diego, CA), rabbit anti-human LAMP was from Sino Biological (Beijing, China). Goat anti-rabbit-HRP, goat anti-mouse IgG1-HRP and goat anti-mouse IgG2a-HRP were purchased from Southern Biotechnologies (Birmingham, AL). Streptavidin-HRP were purchased from Thermo Fisher (Waltham, MA). SureBlue TMB microwell peroxidase substrate and TMB stop solution were purchased from KPL (Gaithersburg, MD). ELISPOT antibody pairs for IFNγ, and IL-10 was from BioLegend. Cytokine ELISA kits were from R&D systems.

Vaccines, and immunizations. Control, IGFBP2 (39-328)-ILC-1 Construct, and IGFBP2 (1-328)-no LAMP vaccines were used in a total volume of 20 μl per mouse per dose. Mice were immunized with the vaccine by IM delivery via electroporation on days 0, 7, and 14. Mice were bled on days −13, and 28 for serum collection. Serum was collected and stored in −30° C. Spleens were collected on day 28 and processed for ELISPOT/ELISA assays.

Measurement of serum IGFBP-2-specific IgG by ELISA. The murine antibody response to IGFBP-2 was assessed by indirect ELISA. ELISA plates (MaxiSorp) were coated with 5 ug/ml IGFBP2 (39-328) protein in carbonate bicarbonate buffer overnight and then blocked with 2% BSA in PBS. Serum samples were diluted (1:100, 1:300, 1:900, 1:2700, 1:8100, 1:24300, 1:72900, 1:218700) in PBS-T. Samples were detected with 1:6000 goat anti-mouse IgG-HRP (Southern Biotech, Birmingham, Al), followed by Streptavidin-HRP (Thermo Fisher Scientific, Rockford, IL). Reaction was developed with SureBlue TMB Substrate and stopped with TMB Stop Solution from KPL (Gaithersburg, MD). Plates were read (OD450) by using Epoch ELISA reader (BioTek, Winooski, VT). Average background (PBS only) was calculated, and samples which have OD450 value more than 2*average background were considered as positive. The dilutions of such samples are determined as the endpoint titers.

Evaluation of antigen-specific T cell response. To assess antigen-specific T cell response in the vaccinated mice, splenocytes from vaccinated mice were evaluated for antigen-specific IFNγ, and IL-10 by Enzyme-linked immunospot (ELISPOT).

Splenocytes were depleted of RBCs and co-cultured in flat bottom 96-well plates in 200 μl/well T cell media (RPMI-1640 with L-Glutamine and HEPES (ATCC), 1% penicillin, 1% streptomycin, and $5 \times 10^{-5}$M 2-ME) at $4 \times 10^5$ cells/well and 10 µg/ml IGFBP2 (39-328) protein or concavalin A (0.25 µg/ml) or medium alone for 72 h at 37° C. in 5% $CO_2$. Plates were centrifuged at 1600 rpm for 6 minutes and supernatants were collected and stored at −30° C.

For ELISPOT assays were performed as described herein. Briefly, 96-well nitrocellulose plates (Millipore), were activated with 30 ul of 35% ethanol for one minute, washed with PBS twice, and coated overnight at 4° C. with 50 µl/well of capture monoclonal antibody in PBS. The plates were washed three times with 200 µl/well PBS and blocked with 200 µl/well T cell media for at least 2 hrs at room temperature. Splenocytes were plated at $4 \times 10^5$ cells/well and co-cultured with 10 µg/ml IGFBP2 (39-328) protein or 10 ug/ml peptide pools or concavalin A (0.25 µg/ml) or medium alone in a total volume of 200 µl/well T cell media for 48 h at 37° C. in 5% $CO_2$. The plates were washed, diluted detection antibodies (50 µl/well) were added and plates were incubated for 2 hrs at room temperature on shaker. Plates were washed four times with PBS. Streptavidin-HRP diluted in PBS (50 µl/well) were added and incubated for 1 h. Plates were washed with PBS and developed with 50 µl/well AEC development solution for up to 30 min. Color development was stopped by washing under running tap water. After drying 24-72 h at room temperature in dark, colored spots were counted using an AID ELISPOT High-Resolution Reader System and AID ELISPOT Software version 3.5 (Autoimmun Diagnostika GmbH).

Evaluation of intracellular cytokine. To determine the cells responsible for production of cytokines intracellular staining was performed. Splenocytes were depleted of RBCs stored in refrigerator for 24 h. Next day splenocytes were co-cultured in flat bottom 96-well plates in 200 µl/well T cell media (RPMI-1640 with L-Glutamine and HEPES (ATCC), 1% penicillin, 1% streptomycin, and 5×10−5M 2-ME) at $3 \times 10^6$ cells/well and 20 ug/ml IGFBP2 (39-328) protein or peptide pool or medium alone. A mixture of Brafeldin A and monensin (×1000) was added to each well in 20 ul volume (0.22 ul per well for 20 ul volume; prepare a stock for all the wells) one hour later. PMA/ionomycin activation cocktail was added to positive control wells along with BFA and Monensin (Two wells were set-up; one for IgG control and other one for cytokine staining). Cells were incubated for total of 6 h at 37° C. in 5% $CO_2$.

Cells were washed with 200 µl PBS. Cells were stained with 50 µl of diluted Zombie aqua dye (1:500 dilution of zombie aqua in PBS) and incubated for 20 min at room temperature protected from light. Cells were washed once with 2% serum in PBS. 20 ul of purified anti-mouse CD16/32mAb (clone 2.4G2; 1 ug/20 ul) was added to the cells and cells were incubated at 4° C. for 10 mins. Cells were centrifuged (2000 rpm, 6 min), supernatant was decanted, and extracellular antibodies were added in PBS supplemented with 2% serum. The antibodies were 0.3 ul of each/well. Abs were added in a volume of 50 µl/well, incubated for 30 min in 4° C. (the CD3 clone 17A2 can activate T cells so 4° C. temperature is important).

Cells were washed with PBS+protein (2% FCS), fixed and permeabilized with 100 µl of CYTOFIX/CYTOPERM™ solution at 4° C. for 30 mins (mixed thoroughly with the multichannel when adding the fix buffer to reduce aggregates and doublets formation). Cells were washed with 200 µl Perm/Wash buffer (1λ) twice (2000 rpm, 6 min). Cells were stained with the intracellular staining Ab at 0.5 µl Ab/well in Perm buffer. One of the PMA/ionomycin wells were stained with the isotype controls. After 1 h (or overnight) incubation cells were washed twice with perm buffer, and cells were acquired by flow cytometer. While acquisition the events/second were less than 8000. Acquired $>10^6$ cells per sample. The acquired data were analyzed using Kaluza analysis software. Dead cells and doublets were gated out.

Statistics. Statistical analyses were performed by using Prism 6 software (GraphPad Software, La Jolla, CA). Data were analyzed by one-way ANOVA followed by Tukey's test for multiple comparisons. p values below 0.05 were considered to indicate a statistically significant difference.

Figure 21:
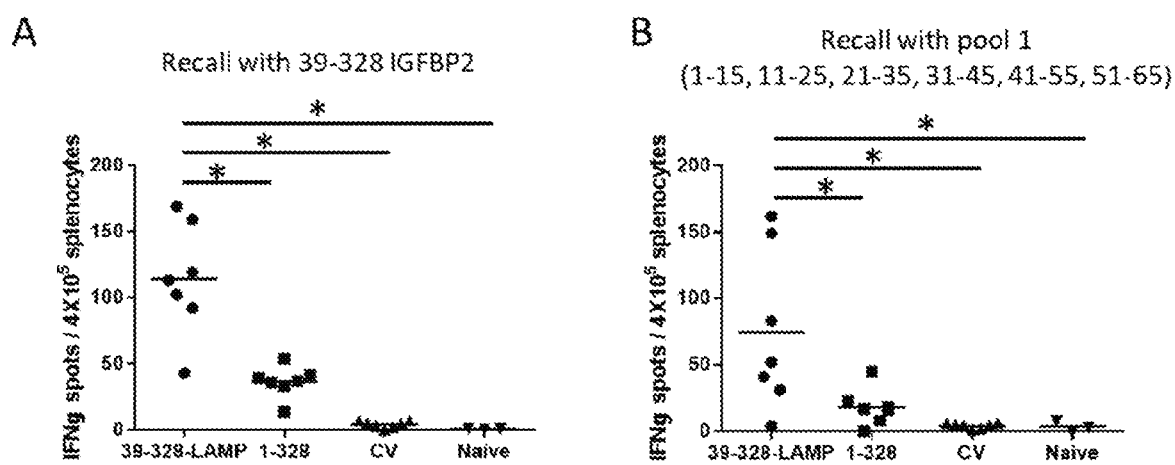

Results. FIG. 21: IGFBP2 (39-328)-ILC-1 Construct induced significantly higher IFNγ producing effector T cells at the dose of 10 ug IM/EP immunization. Peptide pool 1 induced the IFNγ response similar to IGFBP-2 full length protein indicating dominant epitope in peptide pool 1. Splenocytes ($4 \times 10^5$/well) were stimulated with IGFBP-2 protein (10 ug/ml) or peptide pool (10 ug/ml) in T cell media (RPMI with 10% heat inactivated FBS, 1% penicillin/streptomycin, and 1×2-ME), for 48 h. Values in dot plot are experimental—media for each mouse. N=7 mice per group. FIG. 21A. Dot plot to show recall with IGFBP2 full length (10 ug/ml) and FIG. 21B. Dot plot to show recall with peptide pool 1 (10 ug/ml). * indicates p<0.05.

Figure 22:
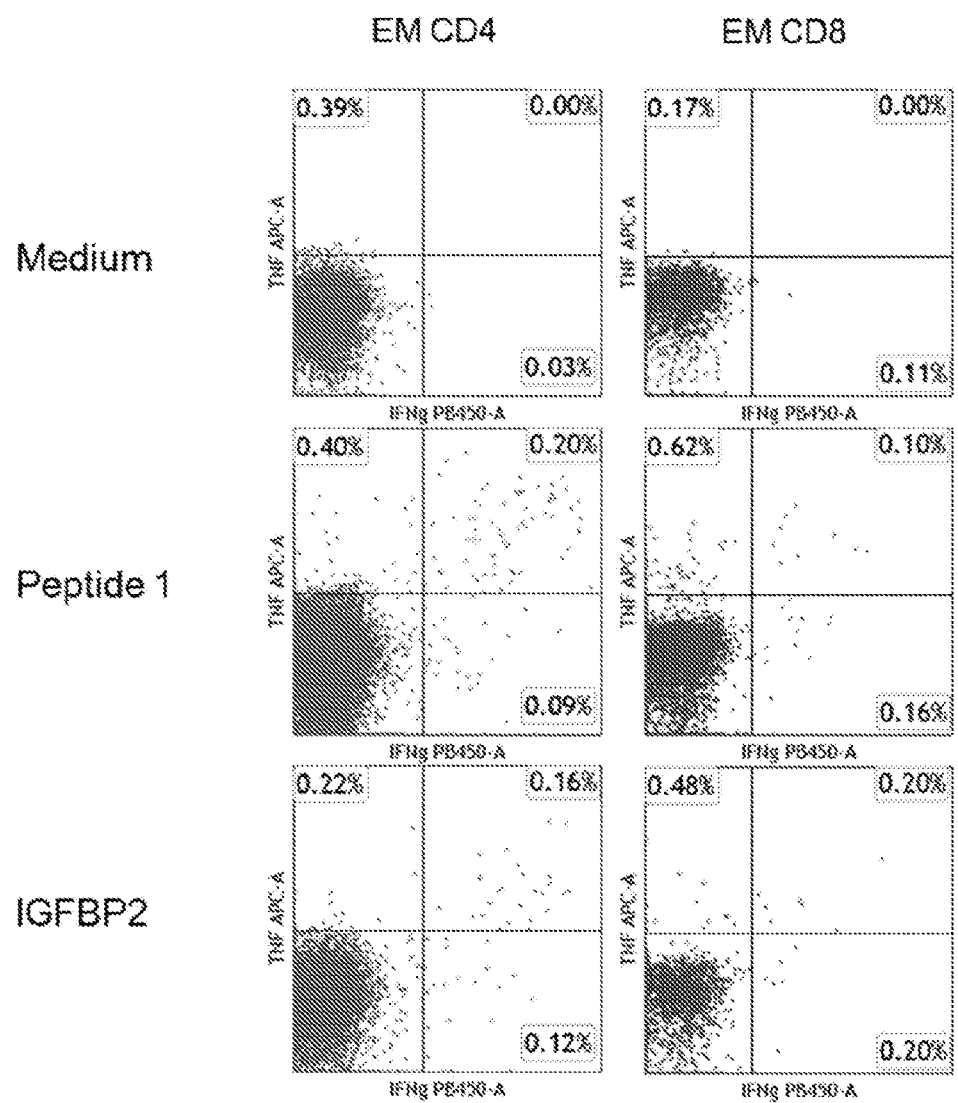

FIG. 22. IGFBP2 (39-328)-ILC-1 Construct induced IFNγ and/or TNFα producing CD4+ and CD8+ effector memory T cells at the dose of 10 ug IM/EP immunization. Splenocytes ($4 \times 10^5$/well) were stimulated with IGFBP-2 protein (10 ug/ml) or peptide pool 1 (5 ug/ml) in T cell media (RPMI with 10% heat inactivated FBS, 1% penicillin/streptomycin, and 1×2-ME), for 6 hr. Cells were stained for intracellular cytokines as described and analyzed as shown below. Representative data from each group.

Figure 23:
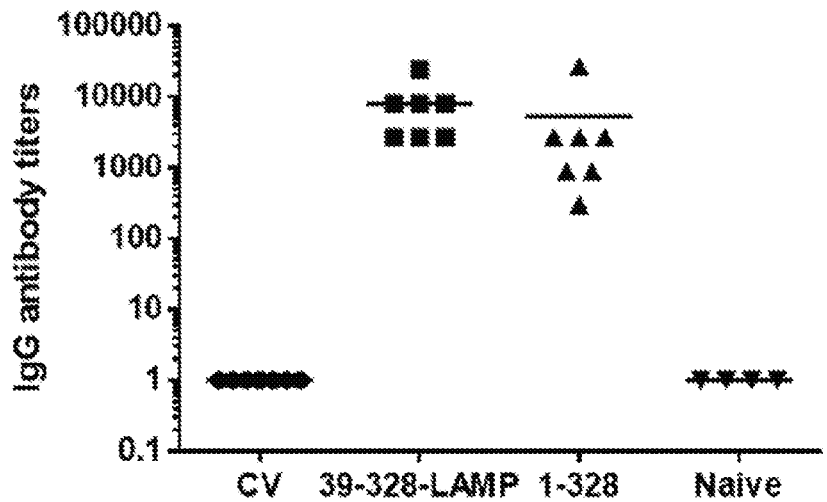

FIG. 23: IGFBP-2-specific IgG production in C57BL/6 albino mice immunized with IGFBP2 (39-328)-ILC-1 Construct by IM/EP. Female C57BL/6 albino mice were immunized IM/EP with 10 ug of the indicated vaccines in 20 µl PBS on day 0, 7, and 14. Mice were bleed on days-6, 28. Serum was separated and stored in-30° C. IgG were determined in plasma by ELISA. Briefly, ELISA plates were coated with 5 µg/ml IGFBP-2 (39-328) in carbonate bicarbonate buffer, blocked with 2% BSA, serum (1:100 dilution in PBS-T) were evaluated by HRP-conjugated goat anti mouse IgG (1:6000). Average background (PBS only) was calculated, and samples which have OD450 value more than 2*average background are considered as positive. The dilutions of such samples are determined as the endpoint titers.

REFERENCE RELIED UPON IN THIS EXAMPLE

1. Melero, I. et al. Therapeutic vaccines for cancer: an overview of clinical trials. *Nat Rev Clin Oncol* 11, 509-524 (2014).
2. Obeid, J., Hu, Y. & Slingluff, C. L., Jr. Vaccines, Adjuvants, and Dendritic Cell Activators—Current Status and Future Challenges. *Semin Oncol* 42, 549-561 (2015).
3. Pol, J. et al. Trial Watch: Peptide-based anticancer vaccines. *Oncoimmunology* 4, e974411 (2015).
4. Speiser, D. E. & Romero, P. Molecularly defined vaccines for cancer immunotherapy, and protective T cell immunity. *Semin Immunol* 22, 144-154 (2010).
5. Thomas, A. & Giaccone, G. Why has active immunotherapy not worked in lung cancer? *Ann Oncol* 26, 2213-2220 (2015).

6. Ebert, L. M. et al. A cancer vaccine induces expansion of NY-ESO-1-specific regulatory T cells in patients with advanced melanoma. *PLoS One* 7, e48424 (2012).
7. Galon, J. et al. Type, density, and location of immune cells within human colorectal tumors predict clinical outcome. *Science* 313, 1960-1964 (2006).
8. Fridman, W. H., Pages, F., Sautes-Fridman, C. & Galon, J. The immune contexture in human tumours: impact on clinical outcome. *Nat Rev Cancer* 12, 298-306 (2012).
9. Kenter, G. G. et al. Vaccination against HPV-16 oncoproteins for vulvar intraepithelial neoplasia. *N Engl J Med* 361, 1838-1847 (2009).
10. Madan, R. A., Bilusic, M., Heery, C., Schlom, J. & Gulley, J. L. Clinical evaluation of TRICOM vector therapeutic cancer vaccines. *Semin Oncol* 39, 296-304 (2012).
11. Disis, M. L. et al. Concurrent trastuzumab and HER2/neu-specific vaccination in patients with metastatic breast cancer. *J Clin Oncol* 27, 4685-4692 (2009).
12. Moore, L. M. et al. IGFBP2 is a candidate biomarker for Ink4a-Arf status and a therapeutic target for high-grade gliomas. *Proc Natl Acad Sci USA* 106, 16675-16679 (2009).
13. Busund, L. T. et al. Significant expression of IGFBP2 in breast cancer compared with benign lesions. *J Clin Pathol* 58, 361-366 (2005).
14. Hu, Q. et al. Is insulin-like growth factor binding protein 2 associated with metastasis in lung cancer? *Clin Exp Metastasis* 31, 535-541 (2014).
15. Boulle, N., Logie, A., Gicquel, C., Perin, L. & Le Bouc, Y. Increased levels of insulin-like growth factor II (IGF-II) and IGF-binding protein-2 are associated with malignancy in sporadic adrenocortical tumors. *J Clin Endocrinol Metab* 83, 1713-1720 (1998).
16. Miyake, H., Hara, I., Yamanaka, K., Muramaki, M. & Eto, H. Prognostic significance of insulin-like growth factor (IGF) binding protein-2 to IGF-binding protein-3 ratio in patients undergoing radical cystectomy for invasive transitional cell carcinoma of the bladder. *BJU Int* 95, 987-991 (2005).
17. Shi, L. H., Zhu, X. Q., Zhao, G. H., Xia, Y. B. & Zhang, Y. S. Expression of insulin-like growth factor binding protein-2 in gastric carcinoma and its relationship with cell proliferation. *World J Gastroenterol* 12, 6285-6289 (2006).
18. Lee, E. J. et al. Insulin-like growth factor binding protein 2 promotes ovarian cancer cell invasion. *Mol Cancer* 4, 7 (2005).
19. Lukanova, A. et al. Risk of ovarian cancer in relation to prediagnostic levels of C-peptide, insulin-like growth factor binding proteins-1 and -2 (USA, Sweden, Italy). *Cancer Causes Control* 14, 285-292 (2003).
20. Degraff, D. J., Aguiar, A. A. & Sikes, R. A. Disease evidence for IGFBP-2 as a key player in prostate cancer progression and development of osteosclerotic lesions. *Am J Transl Res* 1, 115-130 (2009).
21. Shariat, S. F. et al. Association of preoperative plasma levels of insulin-like growth factor I and insulin-like growth factor binding proteins-2 and -3 with prostate cancer invasion, progression, and metastasis. *J Clin Oncol* 20, 833-841 (2002).

Example 10: LAMP Constructs Comprising CMV pp65 and gB

Glioblastoma multiforme (GBM) brain cancer is an aggressive human brain cancer with 5 year survival rates below 10% (Schuessler A et al. 2014). Current treatment includes surgical removal of the tumor and radiation, however successful treatment increases the median survival to only about 15 months. Several clinical trials are currently being evaluated for GBM, including immunotherapy. Interestingly, it was recently found that GBM tumors express CMV antigens including the antigen pp65. The role of CMV in GBM is unclear because CMV is not an oncogenic virus, however from a therapeutic perspective, the presence of CMV antigens provides a unique opportunity to exploit pre-existing antiviral immunity for immune-based GBM treatment. A recent report showed that autologous immunotherapy using DC transfected with LAMP-pp65 mRNA in a unique protocol significantly improved GBM patient' survival. Specifically, Dr. Duane A. Mitchell from University of Florida, has shown that autologous DCs generated ex vivo, pulsed with LAMP-pp65 mRNA and injected back into GBM patients significantly improved the survival of GBM patients. The protocol for pp65-transfected DC also required pre-conditioning of the injection site by injection of Tetanus/Diphtheria vaccine 24 h before DC injection (Mitchell D A et al, 2015).

Here, we compare pp65+ILC-1 LAMP construct with gB+ILC-1 LAMP vaccine using PHARMAJET® and ID/EP.

Materials and Methods

Reagents. Plasmid constructs Control, pp65+ILC-1 LAMP construct, and gB+ILC-1 LAMP were constructed as described herein. pp65 and gB peptides for ELISPOT were purchased from JPT (70% purity). RBC lysis buffer was purchased from TonboBio and filtered through 0.22 μm filter. ConA (Sigma) was used at 2.5 ug/ml. Antibodies for IFNγ ELISPOT were purchased from eBioscience or Biolegend. IL-10 ELISPTO reagents, SA-ALP and BCIP/NBT plus were purchased from MabTech. Ab Titers were evaluated using HRP anti-mouse antibodies from Southern Biotech. Lysate of cells infected by CMV was purchased from Virusys. The lysate was confirmed by the manufacturing company to be non-infective.

Immunization and Plasma Collection. Six to eight week old male BALB/C mice bred and maintained at animal facility in Immunomic Therapeutics, Inc. Mice were immunized with the vaccine by either ID (PHARMAJET®) or ID via electroporation on days 0, 7, and 14. Mice were sacrificed on Day 26.

ELISPOT. ELISPOT was carried out as described herein, with the exception of cell number: the cells were seeded at $2*10^5$ splenocytes per well. Spleens from sacrificed mice were flushed with medium, red blood cells were lysed and then the cells were counted using a cellometer. $2*10^5$ splenocytes were seeded per well of ELISPOT and incubated with medium (RPMI with HEPES+10% HI equal Fetal+NaP+ßME+P/S), duplicate of PP65 and gB peptides (1 μg/ml of each peptide) or ConA (2.5 ug/ml). Results are shown after averaging the duplicate and reducing the value from RPMI well for each mouse.

Antibody titers. Antibodies titers were evaluated using a lysate of cells infected by CMV. Total IgG and IgG2a were evaluated. The results were only calculated for total IgG and only the 1:100 OD result was compared.

Figure 24:
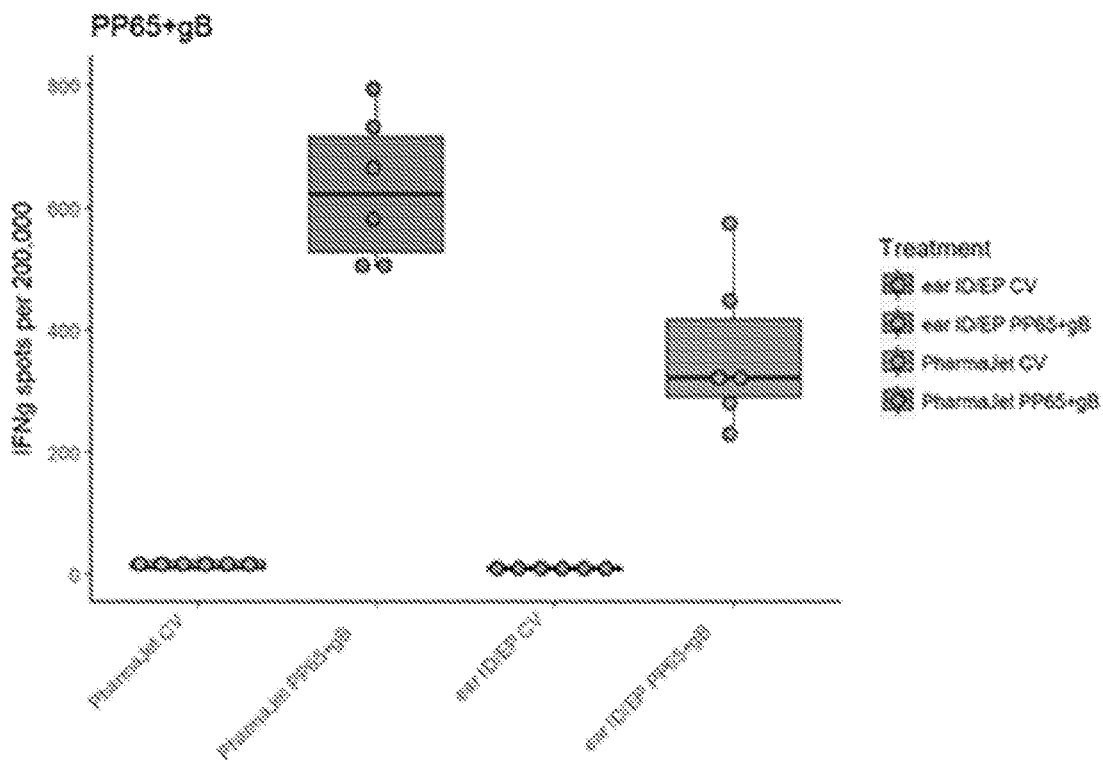
Figures 25, 26:
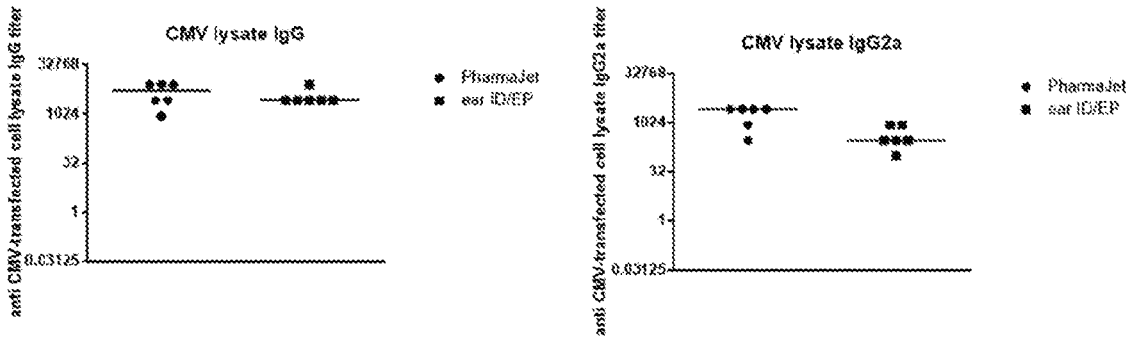
FIG. 26 shows PSMA-ILC-1 LAMP Construct induced significantly higher IFNγ producing effector T cells at the dose of 20 ug ID/EP immunization.

Results. FIG. 24 shows that IFNγ was induced with both pp65 and gB peptides. Additionally, serum Ab were tested from the last bleed. When lysate from CMV-transfected cells was used, similar IgG titers are seen for both immunizations. Specifically, FIG. 25 shows that total IgG (left) and IgG2a (right) antibodies titer at in serum of immunized mice against CMV-transfected cell lysate. Statistical analysis was done in GraphPad prism, using Mann Whitney test. IgG2a CMV-lysate Ag—P=0.041

Example 11. LAMP Constructs Comprising PSMA

Prostate cancer is the most frequently diagnosed cancer in men, and the second most common cause of cancer death in men in the US[1]. For localized disease, surgery and radiation continue to be curative treatments but have adverse effects such as urinary symptoms and sexual dysfunction that can negatively affect quality of life. For metastatic disease, chemotherapy as initial treatment now appears to extend survival compared with androgen deprivation therapy alone (ADT)[2]. ADT is associated with a) decreased bone mineral density and an increased risk of osteoporotic fragility fractures, b) development of castration resistant prostate cancer (CRPC). Methods to harness the immune system to recognize and kill prostate cancer cells are being exploited. One such attempt has led to Sipuleucel-T, a FDA approved, autologous cellular immunotherapy that targets prostatic acid phosphatase (PAP) for the treatment of asymptomatic or minimally symptomatic metastatic CRPC (mCRPC)[3]. Additional immunotherapies for prostate cancer are under development including a number of vaccine candidates, as well as approaches using targeted monoclonal antibodies[4, 5].

Several tumor-associated antigens (TAAs) have been identified that represent promising targets for T cell- or antibody-based immunotherapy. The group of molecules preferentially expressed in normal and malignant prostate tissues comprises prostate-specific membrane antigen (PSMA), prostein, prostate-specific antigen (PSA), prostatic acid phosphatase (PAP), prostate stem cell antigen (PSCA), T cell receptor gamma alternate reading frame protein (TARP), transient receptor potential (trp)-p8 and six-transmembrane epithelial antigen of the prostate 1 (STEAP1).

Human Prostate Specific Membrane Antigen (PSMA), also known as folate hydrolase I (FOLH1), is a 750-amino acid type II membrane glycoprotein, which is primarily expressed in normal human prostate epithelium and is upregulated in prostate cancer, including metastatic disease. Mouse homolog of PSMA (Folh1) is not expressed in the mouse prostate, but primarily expressed in the brain and kidney. Mouse Folh1 encodes for a 752-amino acid protein, with 86% identity and 91% similarity to the human PSMA amino acid sequence[6]. PSMA is considered an important clinical biomarker of prostate because it is expressed many fold higher on prostate cells than cells of other tissues[7, 8, 9]. A strong correlation between increased PSMA expression and prostate cancer progression has been indicated[10]. Elevated PSMA expression is also associated with other malignancy including kidney and bladder cancer[11]. Elevated PSMA expression has been observed on tumor neovasculature, but not normal vasculature suggesting a role for PSMA in angiogenesis[12]. PMSA being a membrane protein is an attractive target to develop antibodies against it for diagnostic and therapeutic purposes[13]. Several therapeutic anti-PSMA mAbs have been developed, and many of these have been used in radioimmunotherapy for targeting cytotoxic radionucleotides, specifically to PSMA expressing cells[14]. Some anti-PSMA mAbs have been demonstrated to mediate a therapeutic effect by promoting an antibody-dependent cellular cytotoxicity (ADCC) effect that kills prostate cancer cells[4, 14, 15].

Materials and Methods

Mice. Six to eight week old female C57BL/6 albino mice were purchased from Envigo and maintained at animal facility in Immunomic Therapeutics, Inc. (Rockville, MA).

Reagents and antibodies. Control and PSMA-ILC-1 LAMP Constructs were made as described herein. Human PSMA PepMix (185 peptides, 15mers with 121aa overlap) was from JPT (Acton, MA). Mouse anti-human PSMA Alexa Flour 488, Goat (Fab) 2 anti-mouse IgG-Fc PE were from abcam (Cambridge, MA), rabbit anti-human LAMP was from Sino Biological (Beijing, China). Goat anti-rabbit-HRP, goat anti-mouse IgG1-HRP and goat anti-mouse IgG2a-HRP were purchased from Southern Biotechnologies (Birmingham, AL). Streptavidin-HRP were purchased from Thermo Fisher (Waltham, MA). SureBlue TMB microwell peroxidase substrate and TMB stop solution were purchased from KPL (Gaithersburg, MD). ELISPOT antibody pairs for IFNg was from BioLegend.

Vaccines, and immunizations. Control vector, PSMA-ILC-1 LAMP Construct was used in a total volume of 20 µl per mouse per dose. Mice were immunized with the vaccine by ID via electroporation on days 0, and 21. Serum was collected and stored in −30° C. Spleens were collected on day 34 for ELISPOT/ELISA assays.

Evaluation of antigen-specific T cell response. To assess antigen-specific T cell response in the vaccinated mice, splenocytes from vaccinated mice were evaluated for antigen-specific IFNγ and IL-10 by Enzyme-linked immunospot (ELISPOT). Splenocytes were depleted of RBCs and co-cultured in flat bottom 96-well plates in 200 µl/well T cell media (RPMI-1640 with L-Glutamine and HEPES (ATCC), 1% penicillin, 1% streptomycin, and 5×10−5M 2-ME) at $4 \times 10^5$ cells/well and 10 µg/ml IGFBP2 (39-328) protein or concavalin A (0.25 µg/ml) or medium alone for 72 h at 37° C. in 5% $CO_2$. Plates were centrifuged at 1600 rpm for 6 minutes and supernatants were collected and stored at −30° C.

For ELISPOT assays were performed as described herein. Briefly, 96-well nitrocellulose plates (Millipore), were activated with 30 ul of 35% ethanol for one minute, washed with PBS twice, and coated overnight at 4° C. with 50 µl/well of capture monoclonal antibody in PBS. The plates were washed three times with 200 µl/well PBS and blocked with 200 µl/well T cell media for at least 2 hrs at room temperature. Splenocytes were plated at $3 \times 10^5$ cells/well and co-cultured with 10, 5, 2, 1, 0.1, 0.01 µg/ml PSMA JPT peptide mix for PSMA or concavalin A (0.25 µg/ml) or medium alone in a total volume of 200 µl/well T cell media for 48 h at 37° C. in 5% $CO_2$. The plates were washed, diluted detection antibodies (50 µl/well) were added and plates were incubated for 2 hrs at room temperature on shaker. Plates were washed four times with PBS. Streptavidin-HRP diluted in PBS (50 µl/well) were added and incubated for 1 h. Plates were washed with PBS and developed with 50 µl/well AEC development solution for up to 30 min. Color development was stopped by washing under running tap water. After drying 24-72 h at room temperature in dark, colored spots were counted using an AID ELISPOT High-Resolution Reader System and AID ELISPOT Software version 3.5 (Autoimmun Diagnostika GmbH).

Measurement of serum PSMA-specific IgG/IgG2a and Prostein-specific IgG/IgG2a by ELISA. The murine antibody response to PSMA was assessed by indirect ELISA. ELISA plates (MaxiSorp) were coated with 5 ug/ml of PSMA protein in carbonate bicarbonate buffer overnight and then blocked with 2% BSA in PBS. Serum samples were diluted (1:100, 1:300, 1:900, 1:2700, 1:8100, 1:24300, 1:72900, 1:218700) in PBS-T. Samples were detected with 1:6000 goat anti-mouse IgG-HRP or 1:11000 goat anti mouse IgG2a-HRP (Southern Biotech, Birmingham, Al), followed by Streptavidin-HRP (Thermo Fisher Scientific, Rockford, IL). Reaction was developed with SureBlue TMB Substrate and stopped with TMB Stop Solution from KPL (Gaithersburg, MD). Plates were read (OD450) by using Epoch ELISA reader (BioTek, Winooski, VT). Average background (PBS only) was calculated, and samples which have OD450 value more than 2*average background were considered as positive. The dilutions of such samples are determined as the endpoint titers.

Evaluation of intracellular cytokine. To determine the cells responsible for production of cytokines intracellular staining was performed. Splenocytes were depleted of RBCs stored in refrigerator for 24 h. Next day splenocytes were co-cultured in flat bottom 96-well plates in 200 ul/well T cell media (RPMI-1640 with L-Glutamine and HEPES (ATCC), 1% penicillin, 1% streptomycin, and 5×10–5M 2-ME) at $3\times10^6$ cells/well and 2 ug/ml PSMA (JPT peptide mix) or medium alone. A mixture of Brafeldin A and monensin (×1000) was added to each well in 20 ul volume (0.22 ul per well for 20 ul volume; prepare a stock for all the wells) one hour later. PMA/ionomycin activation cocktail was added to positive control wells along with BFA and Monensin (Two wells were set-up; one for IgG control and other one for cytokine staining). Cells were incubated for total of 6 h at 37° C. in 5% $CO_2$.

Live/Dead staining (no protein in this step): Cells were washed with 200 µl PBS (no protein to this wash). Cells were stained with 50 ul of diluted Zombie aqua dye (1:500 dilution of zombie aqua in PBS) and incubated for 20 min at room temperature protected from light (no protein in this step). Cells were washed once with 2% serum in PBS.

Fc block: 20 ul of purified anti-mouse CD16/32mAb (clone 2.4G2; 1 ug/20 ul) was added to the cells and cells were incubated at 4° C. for 10 mins.

Surface staining: cells were centrifuged (2000 rpm, 6 min), supernatant was decanted, and extracellular antibodies were added in PBS supplemented with 2% serum. The antibodies were 0.3 ul of each/well. Abs were added in a volume of 50 µl/well, incubated for 30 min in 4° C. (the CD3 clone 17A2 can activate T cells so 4° C. temperature is important).

Fixation and permeabilization: Cells were washed with PBS+protein (2% FCS), fixed and permeabilized with 100 µl of CYTOFIX/CYTOPERM™ solution at 4° C. for 30 mins (mixed thoroughly with the multichannel when adding the fix buffer to reduce aggregates and doublets formation). Cells were washed with 200 µl Perm/Wash buffer (1×) twice (2000 rpm, 6 min)

Intracellular staining: Cells were stained with the intracellular staining Ab at 0.5 µl Ab/well in Perm buffer. One of the PMA/ionomycin wells were stained with the isotype controls. After 1 h (or overnight) incubation cells were washed twice with perm buffer, and cells were acquired by flow cytometer. While acquisition the events/second were less than 8000. Acquired >$10^6$ cells per sample.

The acquired data were analyzed using Kaluza analysis software. Dead cells and doublets were gated out.

Statistics. Statistical analyses were performed by using Prism 6 software (GraphPad Software, La Jolla, CA). Data were analyzed by one-way ANOVA followed by Tukey's test for multiple comparisons. p values below 0.05 were considered to indicate a statistically significant difference.

FIG. 26 shows that the PSMA-ILC-1 LAMP Construct induced significantly higher IFNγ producing effector T cells at the dose of 20 ug ID/EP immunization. Splenocytes ($3\times10^5$/well) were stimulated with PSMA peptide mix from JPT (2, 1, 0.1, 0.01, 0.001 ug/ml) in T cell media (RPMI with 10% heat inactivated FBS, 1% penicillin/streptomycin, and 1×2-ME), for 48h. Values in dot plot are experimental-media for each mouse. N=7 mice per group. Dot plot to show recall with PSMA.

Figure 27:
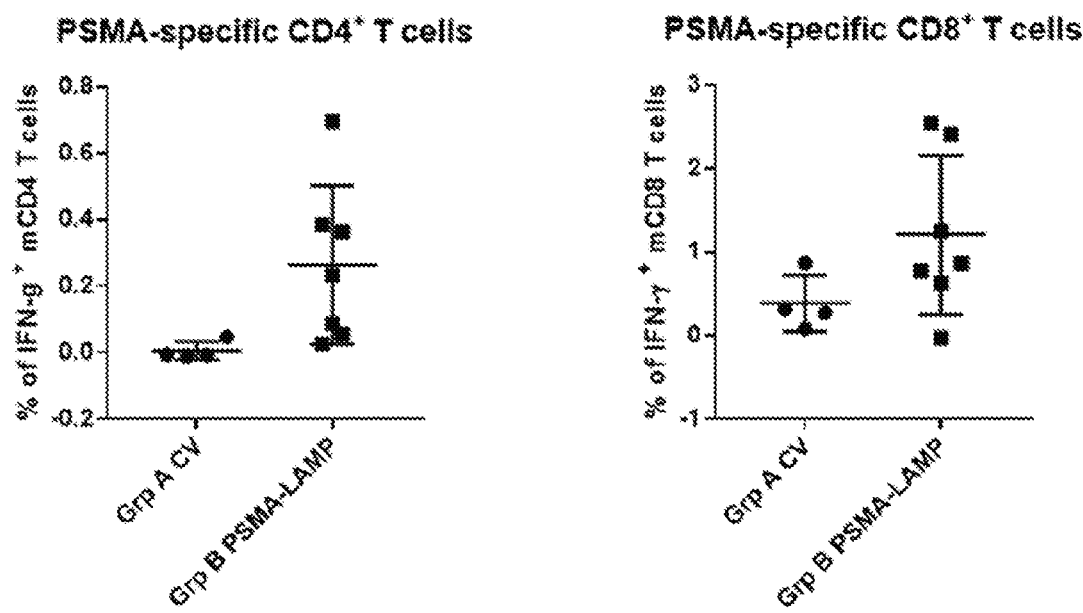
FIG. 27 shows PSMA-ILC-1 LAMP Construct induced IFNγ producing CD4+ and CD8+ effector memory T cells at the dose of 20 ug ID/EP immunization.

FIG. 27 shows that PSMA-ILC-1 LAMP Construct induced IFNγ producing CD4+ and CD8+ effector memory T cells at the dose of 20 ug ID/EP immunization. Splenocytes ($3\times10^5$/well) were stimulated with PSMA peptides (JPT; 2 ug/ml) in T cell media (RPMI with 10% heat inactivated FBS, 1% penicillin/streptomycin, and 1×2-ME) for 6 h. Cells were stained for intracellular cytokines as described and analyzed as shown below. Data from individual mice is shown.

Figure 28:
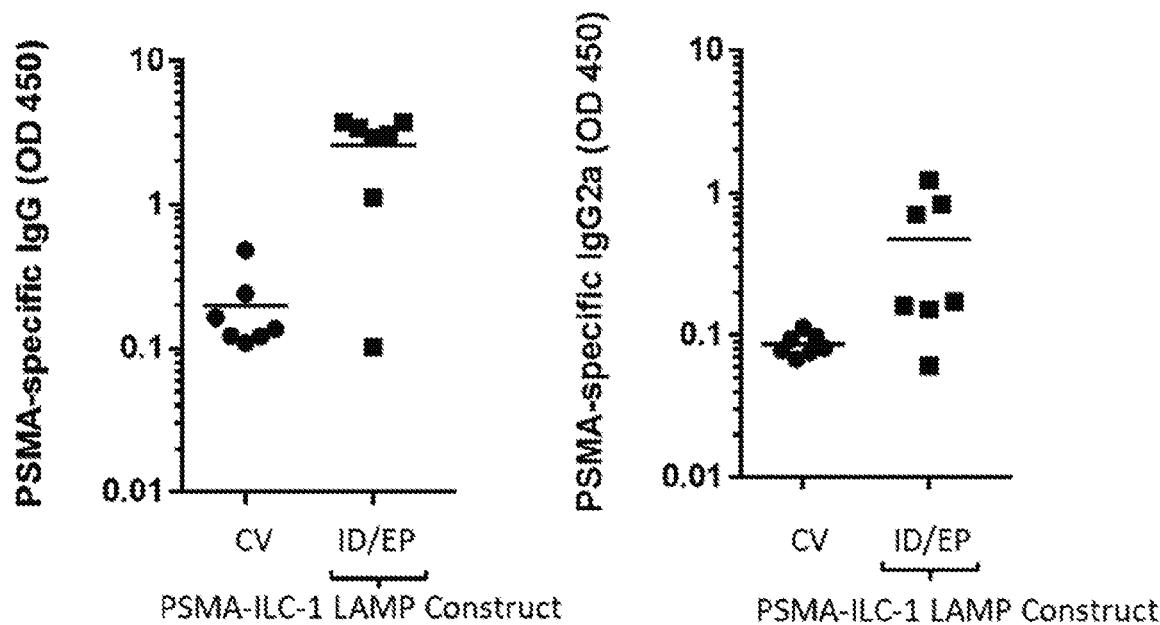
FIG. 28 shows total IgG and IgG2A production in C57BL/6 mice immunized with PSMA-ILC-1 LAMP Construct by immunization via ID/EP.

FIG. 28 shows the total IgG and IgG2A production in C57BL/6 mice immunized with PSMA-ILC-1 LAMP Construct by immunization via ID/EP. IgG were determined in plasma by ELISA. Briefly, ELISA plates were coated with 5 µg/ml of PSMA in carbonate bicarbonate buffer, blocked with 2% BSA, serum (1:100 dilution in PBS-T) were evaluated by HRP-conjugated goat anti mouse IgG (1:6000).

Variations, modifications, and other implementations of what is described herein will occur to those of ordinary skill in the art without departing from the spirit and scope of the invention and the claims. All of the patents, patent applications, international applications, and references identified are expressly incorporated herein by reference in their entireties.

SEQUENCE LISTING (731 sequences)

SEQ ID NO: 1 - protein, 417 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 2 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 3 - protein, 416 aa, Homo sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 4 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 5 - protein, 197 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 6 - protein, 406 aa, Mus musculus
MAAPGARRPLLLLLLAGLAHGASALFEVKNNGTTCIMASFSASFLTTYETANGSQIVNISLPASAEVLKNGSSCGKENVSDPSLTITFGRGYLLTLNFTKNTTRYSVQHMYFTYNLSDTEHFPNAISKEIYTMDSTTDIKADINKAYRCVSDIRVYMKNVTVVLRDATIQAYLSSGNFSKEETHCTQDGPSPTTGPPSPSPPLVPTNPTVSKYNVTGNNGTCLLASMALQLNITYLKKDNKTVTRAFNISPNDTSSGSCGINLVTLKVENKNRALELQFGMNASSSLFFLQGVRLNMTLPDALVPTFSISNHSLKALQATVGNSYKCNTEEHIFVSKMLSLNVFSVQVQAFKVDSDRFGSVEECVQDGNNMLIPIAVGGALAGLVLIVLIAYLIGRKRSHAGYQTI

SEQ ID NO: 7 - protein, 411 aa, Danio rerio
MARAAGVCWTLLMGCVFAAHAVTFEVTDGNSTCIKGELNASFSISYNTTNGTSVSVFALPASASVSERSSCGSAAVPPELALVFGDTHTHTLSLLFSRDQRLYRVSNISLQYNLSDGDIFPQSSSAGVQSVMASVSELMSARLNSTYRCVSSSSISLSAAVNLTLSGVQMEAYMSSANLSADESVCSADQPSTTVAPPPSTTTSPPPIPPVPERGNYSVTDGNGTVCVLALMGLQLNITHTTTQNQSVSELMNLQPNQTTVSGSCGVTESSLRLSDETTNLTFSFTMNSTTQKYYLSAVSVSALWPDMSVVFEAGNTSLSALQCSVGRSYVCSAQQMLSVTPVFSINTFRLQLQPFNITANRFSTAEECRVDQENMLIPIIVGAALAGLVLIVLVAYLIGRKRTHAGYQTI

SEQ ID NO: 8 - protein, 417 aa, Xenopus laevis
MSWRQVKMPVYWMAVMLLIGVVQVATAVQFEVKDGKTNITCILADLSINFSVSYNVSSKMELATFVLPSEAVTNINKSSCGVENTTAPVLAIQFGSNHSLSIHFARNNTRYEVAELVMSYNLSDKIIFPNASENGTKTVSTNKTAVLAENDTVYKCMNPHLIRMDNANATFHDIRLEAYLKQSNFSQKVSTCSEDITPTSAPAPVTTTAPVPAPVPDPPVVQYSVNRSSEPCLLAKVGLQMNITYTTKDGKNGSYVFNIESKGVTVDGNCTNTTAYLSLSTGSIDLRFNFTLNSSLEVFYLDGVSLSTGLPADANDTHFEAANSSLNYMQTNVHKSFKCNSKQTLQITDPFTVNTYHLQVQAFNSDNTFASAVECSLDENGMLVPIVVGAALAGLVLIVLIAYLIGRKRSHAGYQTI

SEQ ID NO: 9 - protein, 417 aa, Pan troglodytes
MAAPGSARRPLLLLLLLLLLGLVHCASAAMFMVKNGNGTACIMANFSASFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPESPSVDKYNVSGTNGTCLLASMGLQLNLTYERKDNTTVTRLLNINPNKTSASGSCGAHLVTLELHSEGSTVLLFLFGMNASSSRFFLQGIQLNTTLPDARDPAFKAANGSLRALQATVGNSYKCNAEEHVRVTKAFSVNIFKVWVQAFKVEGGQFGSVEECVLDENNMLIPIAVGGALAGLVLIVLIAYLVGRKRSHAGYQTI

SEQ ID NO: 10 - protein, 415 aa, Macaca mulatta
MAAPGSARRSLLLLLLLLLGLTHCASAAMFIVKNGNGTACIMANFSAAFSVNYDTKSGPKNMTFDLPSDAKVVLNSSSCGKENTSDPSLVIAFGRGQTLTLNFTRNATRYSVQLMSFVYNLSDTHLFPNASSKEIKTVESITDIRADIDKKYRCVSGTQVHMNNVTVTLHDATIQAYLSNSSFSREETRCEQDRPSPTTAPPAPPSPSPSPVPESPSVDKYNVSGTNGTCLLASMGLQLNLTYERKDNTTVTRLLNINPNKTLASGSCGAHLVTLELHSEGSTVLLFQFGMNASSSRFFLQGIQLNTTLPDARDPAFKAANSSLRALQATVGNSYKCNAEEHVRVTKAFSVNIFKVWVQAFKVEGGQFGSVEECLLDENNMLIPIAVGGALAGLVLIVLIAYLVGRKRSHAGYQT

SEQ ID NO: 11 - protein, 413 aa, Canis lupus familiaris
MAAFGGARPRPLLLLLLAGLVHGAAAVFVVKDANGTACIMANFSAAFLASYETRSGPKNVTFDLPSDAVVLNSSSCGKENTSDPSLMIAFGKGHGLTLNFTRNATRYSVQLMSFIYNLSDTQIFPNASSKETKTVESATDIRADINKKYRCVSNTQIHMHNVTVTFHDVTIQAYLANSNFSKEETRCEQDGPFPTTAPPPPPHPSPSPAPESPSVHKYNVSGANGTCLLASMGLQLNVTYKKKDNTTVVKVVSINPNKTTAGGSCGAQLVTLELRSESVTLLAFQFGMNASTSRFFLQGIQLNMTLPDARDPTFKAGNNSLRALQATIGNSYKCNAGEHVQVTEAFSVNIIKVWVQAFQVQGDKFGSVEECQLDENSMLIPIAVGGALAGLVLIVLIAYLIGRKRSHAGYQTI

SEQ ID NO: 12 - protein, 417 aa, Oryctolagus cuniculus
MEAPGGARRPLLLLLLLGLVHGASAVFVVRNSNGTACIMANFSAVFSVIYESKSGYKNASFELPATAEVQNTSSCGRENTSNPSLQIAFGRGHVLALNFTRNATLYSVPLLSFVYNLSDSDLFPNASSKDIKTVGSTTDIKADIDKRYRCVSDSKVPMGNVTVTLQDATIQAYLWNNSFSQAESRCRQDMPSPTTAPPAPPVPPSPPSPSPPPKPESPSVSRYNVSDGNATCLLASMGLQLNLTYVHRDNATVTRVFNINPNKTKPSGHCGAQQVTLELQSERSTVLVFQFGMNASSGQYFLQGVLLNTTLPDAREPAFSASNSSLRALQATLGNSYKCNSEEHVRVTPAFSLSIFKVWVQAFQVKGDKFGSVEECLLDQDSMLIPIAVGGALAGLVLVVLIAYLIGRKRSHAGYQT

SEQ ID NO: 13 - protein, 409 aa, Bos taurus
MAAPGGARRRPLLLLLFAGLVHGASAVFVVKNGNGTACIMADFSATFLTSYDTRSGPQNKSFELPAGAEVSNSSSCGKENASDSSLVITFGRGHTLTLIFTRNATRYEVQLMRFAYNLSDTDTFPNSSSTGVKTVESATDIKADINKTYRCVSETQVNMDNVTVTLRDAAIQAYLSSSNFSREETRCEQDLPTPTTPPQPAPTPAPASPAVFRYNVSGSNGTCLLASMGLQLNVTYRRVDNKTVTREFNVNPNKTTFGGNCSATLATLELHSENLLLLALQFVMNESSSRVFLQGVQLNLTLPDAKEGSFTATNSSLRALQATAGNSYKCNAEQRLRVTSSFSLNMFRVWLQAFRVDGDKFGPVEECQLDENSMLIPIAVGGALAGLVLIVLLAYLIGRKRSHAGYQTI

SEQ ID NO: 14 - protein, 407 aa, Rattus norvegicus
MAAPGARRPLLLLLLAGLAHSAPALFEVKDNNGTACIMASFSASFLTTYDAGHVSKVSNMTLPASAEVLKNSSSCGEKNASEPTLAITFGEGYLLKLTFTKNTTRYSVQHMYFTYNLSDTQFFPNASSKGPDTVDSTTDIKADINKTYRCVSDIRVYMKNVTIVLWDATIQAYLPSSNFSKEETRCPQDQPSPTTGPPSPSPPLVPTNPSVSKYNVTGDNGTCLLASMALQLNITYMKKDNTTVTRAFNINPSDKYSGTCGAQLVTLKVGNKSRVLELQFGMNATSSLFFLQGVQLNMTLPDAIEPTFSTSNYSLKALQASVGNSYKCNSEEHIFVSKALALNVFSVQVQAFRVESDRFGSVEECVQDGNNMLIPIAVGGALAGLVLIVLIAYLIGRKRSHAGYQTI

SEQ ID NO: 15 - protein, 414 aa, Gallus gallus
MGGAARAVLLGFLQASSSFDVRDSTGKVCIIANLTVAFSVEYKSSGQKQFAHFFLPQNATSQSHSSCGEGNTSHPILALSFGAGHLISLNFSKTLDKYQVEELTFHYNLSDETLFPNATEGKVMVATQKSVIQARIGTEYRCINSKYVRMKHVNITFSNVTLEAYPTNDTFSANKTECREDMVSTTTVAPTTPKHATSQVPTTSPAPTAAPSSPAVGKYNVTGANGTCVLASMGLQLNITYVKKDEKMGLDLLNFIPHNTSASGMCESTSAFLNLAFEKTKITFHFVLNASSEKFFLQGVNVSTTLPSEAKAPTFEASNDSMSESRATVGNSYKCSAEENFQVTDKALVNVFNVQVQAFKVDGDKFGAMEECQLDENNMLIPIIVGAALAGLVLIVLIAYLIGRKRSHAGYQTI

SEQ ID NO: 16 - protein, 413 aa, Sus scrofa
MAAPGGAWRRPLLLLLLLLGLARGASAVFVVSDGNGTACIMADFAAAFEISYDSRSGAKNTTFSLPASAQVLNSSSCGKENTSDSSLVIAFGRGHTLTLSFTRNATRYSVQLMTLVYNLSDAEFFPSASSKGTKTVAASTDIRADLNTKYRCVSNSQVHLLNVTVTLGNATIQAYLANNSFSQQETRCEQDKPSPPTPTAPPTPTPTPAPTSPVVSRYNVSGANGTCLLASMGLQLNVTYRTKDNTTVTRGLNINPNKTTFGGSCSAQLVTLELQGESLRLLALQFALNTSSSRVFLQGVQLNMTLPDARDPSFSAANSSLRALQATAGNSYKCRSEQRLQVTEAFALNVFQVRVQAFRVDGDKFGPAEECQLDENSMLIPIAVGGALAGLVLVVLMAYLVGRKRSHAGYQTI

SEQ ID NO: 17 - protein, 422 aa, Monodelphis domestica
MAEPGGARTPQRLLLLLLGLIHVASSIFVVKNGTGTACIMANFSATFSMNYTTKSGLESTTFRLPQNASVMNSSSCGKENTSNPILEIGFGGGHTLTMNFSSTTQSYQVELLSFSYNLSDATLFPNASKGSEESSVKSKTDIQADIHKKYRCVSSNRITMSNVTIVLSDVTIQAYLSNNTFSKEETRCSQDTPSPSPVPTTHPTTIPVPTPTPTRPPTPAEIPPIFKYNVSDANGTCLLASMGLQLNITYAKKDNSSARIIWNINPNKTVAGGSCSPQVAILELQTENSTLAFSFGMNATTSKFFLREIRFHKFFPDAKDPAFGAVNSSLKELQATVGNSYKCNAEENVHVTDGFSVNIFRVRVQAFKVEGDKFGSVEECLLDENNMLIPIAVGGALAGLVLIVLIAYLIGRKRSHAGYQTI

SEQ ID NO: 18 - protein, 415 aa, Meleagris gallopavo
MARALLAAVLLGFLQASSSFDVRDSTGKVCIIANLTVAFSVEYKSNGQKQFAHFFLPQNATSQSHSSCGEGNTSHPILALSFGAGHLLSLNFSKTLDKYQVEELTFHYNLSDETLFPNASEGKVMEVTQKSVIQARIGTEYRCINSKYIYIRHVNITFSNVTLEAYPTNGTFSTNKTECSEDMVSTTTVAPTTPKHITSQVPATSPAPTAAPSNPAVGKYNVTGANGTCVLASMGLQLNITYLKKDGKTGLDLLNFVPHNTNASGTCENTSAFLNLAFEKTKITFHFVLNASSEKFFLQGVNVSTTLPSEAKAPMFEASNDSMSELRATVGNSYKCSAEENLQVTDKALVNVFNVQVQAFKVDGDKFGAVEECQLDENNMLIPIIVGAALAGLVLIVLIAYLIGRKRSHAGYQTI

SEQ ID NO: 19 - protein, 415 aa, Taeniopygia guttata
MARGLLAAAALLGFLQASSSFEVKDSSGKVCILADLTVAFSVEYKTNVQKEFVHFFLPQNASVDSQSSCGKDNASHPILVLDFGGGHSLSLNFSESADKYQVEELVFHYNLSDATLFPNSSTGGMKTVSHKSIIQAHMGTQYRCINSKHINMKNVNVTFSNVTLEAYLTNGTLSVNKTECAEDRVSTTTMVPTTPKQTTSQSPTTGPAPTSPPNPTVGKYNVTGPNGTCVLAYMGLQLNITYQQKDEKMGLDLLNFVPHNTTSSGRCDNTSALLNLTFEKTRVIFQFALNATAEKFFLQGVSVSTTLPSEAKNPKFEATNNSMSELRASVGNSYKCSSEENLQVTDQALVNVFNVQVQIFKIDGDKFGPVEECQLDENNMLIPIIVGAALAGLVLIVLIAYLIGRKRSHAGYQTI

SEQ ID NO: 20 - protein, 418 aa, Anolis carolinensis
MVSSSSCRRGLLLAAVLLGFLQASSTFEVRDKTGKICILANFSAEFTVDYSTKAKVERKTFQLPSSAHINKESSSCGKEKETSQVLVVEFGTGNSLTFTFEKSNDFYHVSNLTFSYNLSDSSFFPNSSGGQREVSRAGDIQANINTTYRCRSNHRVNMTNVTVLFSNVTLEAYLPNNAFSKNDSVCAEDKTSTVAPPITTHIPTTTSLAPPTPPPTDTPKIGRYNVTGLHGICLLATMGLQVNVTYSTKNKTSKSELLNLPPTAEVSGTCENSSITLNLTSESTSLSFQFSQNTSTEKYFLQGIIVTANLPPEATEKNISYSNHTLNALKTSVGKSYKCIAEESIWISGKAAVNIFNIQLQAFKIPGDKFGAVEECQLDENNMLIPIIVGAALAGLVLIVLIAYLIGRKRSHAGYQTI

SEQ ID NO: 21 - protein, 418 aa, Oryzias latipes
MKSFPSFVALFIVCSAVLADTQAVVTLEVKEGNSTCIKAEFSAVFSITYNTTNDTRTVSVFLPNSTTVDSANSSCGSNGSTPGLMAKFGPGHYFGMNFSTNGSLYSVDTLFLRYNLSDASLFPEANSSGPVDFELSASVGIWAPTNTTYRCLSPTTITITRPSVTFSEMKLEAYMPGNDFSPAERVCAADQTTTGAPTTTTSAATPTTPSPTPAGTPEQGSYSVKNASGTVCLMAKMGVQLNVSYFSQSQNKTVQELLNLTPNLTSSSGLCGGTNATLVLAQEETTVLSFLFTVNSTSNKYHLSGITLQANWTDMMSPFSASNTSLDYLRSSLGHSYMCNAEQTLFVVSTFSINMFELQVQPFGVTSTQFASAEVCQIDQDQMLIPIIVGAALAGLVLIVLIAYLIGRKRSHAGYQTI

SEQ ID NO: 22 - protein, 420 aa, Takifugu rubripes
MKRSHALVVLIIAWFSLSGCIQAVSLEVKEGNSTCIKANLSAYFSITYNTSSSTRTAQFILPDSATVDPDSSTCGGNGSSPWLVAVFGAGHALGLGFSTNGSFYSVANLTLQYNLSDASVFPDANSSGVVTVVSSSVGIWAAVNTTYRCLSSVLFQVGGATVTFSDMRLEAYMPGNDLSPRESFCAADQTTTAPPTTTAAPTTTAATTMAPPAPTPPGTPVRGTYSVVNGNDTTCLLAQMGLQLNVSYFSRSQNKTVQSLVNLTPNLTNSTGSCEKGSATLILTQQTTILIFTFSLNSTSSKYHLSGLSLQANWSDMAAAFSASNASLSYLRSTFGHSYMCNAEQILAVTPVFSLNTFSLQIQPFGVTTNQFAAAEECQMDQDQMLIPIIVGASLAGLVLIVLIAYLIGRKKSHAGYQTI

SEQ ID NO: 23 - protein, 419 aa, Salmo salar
MTRTCPFVVGIACFAILGCVTVVQSQVTLEVTEGNSTCIKAELSASFSITYDTANGTRTVMVPLPGSAVVGVASSCGGDGRSPWLVALFGDGHALGLGFSSNDSLYSVAKLTLQYNLSDVSNFPEANSTDVVTVETTSVGMVARVNTTYRCISASPVIVGGATVTFSNVTMEAFMTGEDLSPNESVCTADQSFTTAPPPPPSTTTAAPAPVPTPPGTPSQGSYSVSNSNGTVCLLARMALQLNISHFSASQNKTIQEVVNLLPNQTTSSGSCDPTSATLVLTQANATNLSFLFTLNSTSNRYHLTGLSVVAAWSDMTAPFNTSNSSLDYQRGSLGRSYMCISEQTLVVDQNFSLNTFQLQVQPFGITRGQFAQAEECQLDQDNMLIPIVVGAALAGLVLIVLIAYLIGRKRSHAGYQTI

SEQ ID NO: 24 - protein, 247 aa, Oreochromis niloticus
MVQICRVQSWFVGVTPLLIFATVLHQGFATVAPPTPAPHKEPGRPERGYYNVTNHNGTICLMAYMGLQLNISYNSTSQKKVVQDVMNLQPNLTKHSGLCDSDIASLNLTVDAVKTNLTFVFTMNSTSNKYHLSEVTVSAAWPEMKEPVSVHNSSLDYLRGTVGYSYFCRDEQTLNVAQNLSINTFQLQVQPFAVKGDQFGAAEECQLDEDDMLIPIVVGAALAGLVVIVLLAYLIGRKRSHAGYQSI

SEQ ID NO: 25 - protein, 415 aa, Mus musculus
MCLSPVKGAKLILIFLFLGAVQSNALIVNLTDSKGTCLYAEWEMNFTITYETTNQTNKTITIAVPDKATHDGSSCGDDRNSAKIMIQFGFAVSWAVNFTKEASHYSIHDIVLSYNTSDSTVFPGAVAKGVHTVKNPENFKVPLDVIFKCNSVLTYNLTPVVQKYWGIHLQAFVQNGTVSKNEQVCEEDQTPTTVAPIIHTTAPSTTTTLTPTSTPTPTPTPTPTVGNYSIRNGNTTCLLATMGLQLNITEEKVPFIFNINPATTNFTGSCQPQSAQLRLNNSQIKYLDFIFAVKNEKRFYLKEVNVYMYLANGSAFNISNKNLSFWDAPLGSSYMCNKEQVLSVSRAFQINTFNLKVQPFNVTKGQYSTAQECSLDDDTILIPIIVGAGLSGLIIVIVIAYLIGRRKTYAGYQTL

SEQ ID NO: 26 - protein, 415 aa, Xenopus laevis
MGDTGAMERCACPAAVLLLSLVLMGATAFEVEIKDDKNATCIYAKLSVNITVQYETDTSSSKNITFPVPSDVTTNGSSCGSDGKAPLLVINFGNSQSWSLNFTRNNSTYSGSALIFTYNTNDTILFPDALRKGLISSTAMFLGPVPLNSTYKCISREVVVSENVTQIIYDVKLEAFMANGTLGKEIICDADKPSPVPSPTQPSTTASTAIPAPTSKPLDKPTMGNYTVSDASGICLLASMGLQINTSLLSEGKNIWRPFNIDPLGIKTNGTCTNQTGTLILTENRTIIEFTFALKNKNHFYLEEVNITLINGSAFSSRQNQNLSTWEASVDSSYMCHKEQQIKVSEDLFINAFDVRVQPFGVNNGTFATAEDCFADQNFIVPIVVGAALGVLVVLVMVAYFIGRRKQSSAGYEQM

SEQ ID NO: 27 - protein, 355 aa, Danio rerio
MAVRGFLPLLFILLSGIVHADDMMTSPLPSTAELKTANLPLVIQTTSSTTSTTTTSRPSSTSTHSTLTTEPAAKTTTARTTVTTSAPTSTQSTSSSSTSATVTTLAPTTTGHNTTNSTTEPPTTTGHNTTNSTTDAPTTTHTNATVAPTPPPTTPSVPKPTVGNYSVKTDNVSDCLLAKMGLQFSFKISGNASLQTVNLDPNVTKVNGTCGSGGSDSSLFLTSKDITVHFVFTNDSQKFRLHALTLTVDLGNGNIFNDSNTNLSLWEASVGSSYMCRKEQSYNISDKLTLNTFELQVQPFDVKKNSFSTAHECSLDDTSLLIPIIVGAALAGLIFIVVIAYVIGRRRTYVGYQTL

SEQ ID NO: 28 - protein, 411 aa, Papio anubis
MVCFRLFPVPGSGLVLVCLVLGAVQSYALELNLTDSGKATCLYAKWQMNFTVRYETTNKTYKTVTISDRGTVTYNGSICGDDQNGPKIAVQFGPGFSWIANFSKAASTYSIDSISFSYNTGDNTTFPDAEDKGIITVDELLAIKIPLNDLFRCNSLSTLEKNDVVQNYWDVLVQAFVQNGTVSTNEFLCDEDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNVSMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 29 - protein, 410 aa, Macaca mulatta
MVCFRLFPVPGSGLVLVCLVLGAVQSYALELNLTDSGKATCLYAKWQMNFTVRYETTNKTYKTVTISDRGTVTYNGSICGDDQNGPKIAVQFGPGFSWIANFSKAASTYSIDSISFSYNTGDNTTFPDAEDKGIITVDELLAIKIPLNDLFRCNSLSTLEKNDVVQNYWDVLVQAFVQNGTVSTNEFLCDEDKTSTVAPTIHTTVPSPTTTPTPKEKPEAGTYSVNNGNETCLLATMGLQLNITQDKVASVININPNTTHSTGSCRSHTALLRLNSSTIKYLDFVFAVKNENRFYLKEVNVSMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKRHHAGYEQF

SEQ ID NO: 30 - protein, 364 aa, Pan troglodytes
  SITE (200)..(200): Xaa can be any naturally occurring amino acid
MVCFRLFPVPGSGLVLVCLVLGAVRSHALELNEADSAINCSKCKTVTISDHGTVTYNGSICGDDQNGPKIAVQFGPGFSWIANFTKAASTYSIDSISFSYNTGDNTTFPDAEDKGILTVDELLAIKIPLNDLFRCNSLSTLEKNDVVQHYWDVLVQAFVQNGTVSTNEFLCDKDKTSTVAPTVHTTVPSPTTTPTRIPPXVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 31 - protein, 411 aa, Canis lupus familiaris
MVCFRLSPAPGSGLVLLCLVLGAVSSYALEVNVTDSEKATCLYAKWQMNFTIQYNTTSKNFKTATISDFSTATYNGSVCGNDQNNPKIVVQFGSGFSWIVNFTKKESAYLIDSISFSYNLSDNATFPDAKEKGILTVHDLVGFRIPLNNIFRCNSLSTLEKNGVVQYYWDVHVQAFVQNGTVSTKEFLCEKDKTSTTVVPTISTTTPSPTTTPTPKEKPEVGSYSVNNSNGTCLLATMGLQLNITHNKVASVININPNTTDFTGSCQPQTALLRLNSSNIKYLDFVFAVKNENRFYLKEVNVSMYLVNGSVFSIANNNLSYWDAPLGSSYMCNKEQTVSVSGAFQINTFDLRVQPFNVMEGKYSTAQECSLDDDTILIPIIVGAGLSGLIIVIVIAYLIGRRKSYAGYQTL

SEQ ID NO: 32 - protein, 417 aa, Equus caballus
MVCFRLSPVPGSGLVLLCLVLGAVSSYALELNLTDSEKALCLYAKWQMNFTIPYETTSKSYKTVTISNFGTPTYNGSICGDNQNGSRIAVQFGSGFSWIVNFTKSVSVYSIDSISFSYNTGDNTTFPDAKDKGILTVNESVAFKIPLNDIFRCNSLSSLVKNGVVQNYWDVHVQAFVQNGTVSTNEYLCEKDNTTTTVAPIVPTTVPSPTTTSSPTTTPSPKEKPDVGSYLVKNGSDTCLLATMGLQLNVTHDKVASVININPNVTGYSGSCHPQTALLRLNSSNIKYLDFVFAVKNENRFYLKEVNVSMYLANGSVFSFANNNLSYWDAPLGSSYMCNKEQTVSVSGEFQINTFDLRVQPFNVKDGKYSTAQDCRADDDNFLVPIAVGAALAGVLILVLLAYFIGLKRHHAGYEQF

SEQ ID NO: 33 - protein, 407 aa, Bos taurus
MVCFRLAPVPGSGFLLLCLVLGAVSSYALELNLTDSSNATCLYAKWQMNFTIRYETTDKHNKTVPISDLGAATYNGSFCGDDQNGPKIAVQFGSGFSWIVNFTKEAASPSTYLVDTISFSYNTNDNKTFPDAKEKEVFTVNNRVALKIPLNDIFRCNSLSTLENRDVVQHYWDVHVQAFVQNGTVSTTEFLCDKDKTVTTAVPIVPTTLPSPTKPVVGSYSVVNSNGTCLLATMGLQLNITHDKVASVFNINPNTTNATGSCQPQTALLRLSSSNIKYLDFVFAVKNENRFYLKEVNVSMILVNGSVYSISNTNLSYWDAPLGSSYMCNKEQTVSVSGAFQINTFDLRVQPFSVTEGKYSTAQECSLDDDTILIPIIVGAGLSGLIIVIVIAYLIGRRKSYAGYQTL

SEQ ID NO: 34 - protein, 411 aa, Sus scrofa
MVCFRLSPVPGSGLLMLCLVLGAVSSYALELNLTNSEKATCLYAKWQMNFTIRYETTNNSHKTVSISDFGAATYNGSFCGDDHNDPQIVMQFGSGFSWIVNFAKESSSYLINSISFSYNTSDTTTFPDAKKKGVLTVNDSVGFQVPLNDIFRCNSLSTLEKDNVVQHYWDVHVQAFVQNGTVSTKEFLCDKDKTLTTTVPVIPTSVPSPTTTPTPKEKPETGSYSVTSSNGTCLLANMGLQLNITQDKVASVININPNTTNATGNCHSKTALLRLSGSNIKYLDFVFAVKNDNRFYLKEVNVSVYLVNGSVFSIANNNLSYWDAPLGSSYMCNKEQTVSVSGAFQINTFNLRVQPFSVMEGKYSTAQDCSADDDNFIVPIAVGAALAGVLILVLLAYFIGLKRHHAGYEQF

SEQ ID NO: 35 - protein, 408 aa, Ovis aries
MVCFRLAPVPGCGFLLFCLVLGTVSSYALELNLTDSSKATCLYAKWQMNFTIRYETTDKHNKTVTISDFDAAAYNGSVCGDDQNGPKIAVQFGSGFSWIVNFTKEASSTSTYLVDSISFSYNTNDNATFPDAKEKGVFTVNNRVALKIPLNDIFRCNSLSTLEKSDVVQHYWDVHVQAFVQNGTVSTTEFLCDKDKTVTTAMPIVPTTAPSPTKPVVGSYSVVNSNGTCLLATMGLQLNITHDKVASVFNINPNTTNATGSCQPQTALLRLSSSNIKYLDFVFAVKNENRFYLKEVNVSMILVNGSVYSISNTNLSYWDAPLGSSYMCNKEQTVSVSGALQINTFDLRVQPFSVTEGKYSTAEECSADSDLNFLIPVAVGVALGFLIIVVFISYMIGRRKSRTGYQSV

SEQ ID NO: 36 - protein, 411 aa, Rattus norvegicus
MRLLSPVTGSKLVLLFLFLGAVRSDALKLNLTDSKGTCLYAEWEMNFTITYEALKVNETVTITVPDKVTYNGSSCGDDKNGAKIMIQYGSTLSWAVNFTKEASQYFINNITLSYNTNDTKTFPGAVPKGILTVIIPVGSQLPLGVIFKCSSVLTFNLSPVVQHYWGIHLQAFVQNGTVSKHEQVCKEDKTATTVAPIIHTTVPSPTTTLTPTSIPVPTPTVGNYTISNGNATCLLATMGLQLNITEEKVPFIFNINPATTNFTGSCQPQTAQLRLNNSQIKYLDFIFAVKNEKRFYLKEVNVNMYLANGSAFHVSNNNLSFWDAPLGSSYMCNKEQVVSVSRTFQINTFNLKVQPFNVTKGEYSTAQDCSADEDNFLVPIAVGAALGGVLILVLLAYFIGLKRHHTGYEQF

SEQ ID NO: 37 - protein, 570 aa, Ornithorhynchus anatinus
MAMKNFTLQQERDTSVALIIRTYVRAFLKVYTKVPKPQRCHNQWQSLNIEGIEGIEIVKGSKWRSALETIITIQVKRKSQVQKYHPFSLHSECQKTNQEGTGGVATVIADECLLWPSIPFSTLAQKVNLGSCEAFSIIGYSVFALFIYLKPNMLDFIELAELMLSTETQLLEPTRVCCGICQSYALEINLTDSKNATCLYSKWQMTFTINYETTGNETKNVTVTVPENVTYDGSSCGDNQTVPQIAVQFGLGYSWHLNFTKKENNSYSFDTIVFTYNTSDNETFPEAKEKGQVLSVFEFRYARIPLNKIFRCHSEESLIGDKATHHYWETVVQAFIQNGTISKEEFICSKDRASTTVAPVTTQVVPSTTATPVPQDKPYPGKYAVKNGNDTCLLATMGLQLNVTQNKVNSVININPNVTDFTGSCSNETAELRLSGSNVKYIDFIFAVKNGNRFYLKEVNVSISFVNASDLNVANNNLSYWDAPLGSSYMCNKEQTLALADSLQINTFNLRVQPFSVVAGKYSTAEDCSADDDNFIVPIAVGAALGGLVILVLMAYFVGRKRRATGYEQF

SEQ ID NO: 38 - protein, 425 aa, Gallus gallus
MAPPRCPAGLALLLLLLGACGFFQSYAVEVDVKDASNFTCLYAQWMMKFLIKYETNSSDYKNASLDLTSTVTHNGSICGSDTQAALLAVQFGDGHSWSINFTKNNETYRAEFITFTYNTNDTAVFPDARRQGPVTIVVKDAMHPIQLNNVFVCHHTTSLEAENVTQIFWNVTMQPFVQNGTISKKESRCYADTPTAAPTVLPTVANVTTASTTISPAPTTAPKPAENPVTGNYSLKTGNKTCLLATVGLQLNISQDKPLLINIDPKTTHADGTCGNTSATLKLNDGNRTLIDFTFIVNASASVQKFYLREVNVTLLNYQNGSVILSADNNNLSKWDASLGNSYMCRKEQTLEINENLQVHTFNLWVQPFLVKENKFSIAEECFADSDLNFLIPVAVGMALGFLIILVFISYIIGRRKSRTGYQSV

SEQ ID NO: 39 - protein, 556 aa, Taeniopygia guttata
MECREGEVTRCKQKNNLFSGINDDISGAKQAKQRQCTPQKPPKRATATLPLQRPPRGIPGPAPAAVAAAVAADRITPSGSHQTRPPEAARDERPVRDPRNRAAAPSGHWRRAGGPQRHRHHRHRRHGPAPLRRLLLRPPPPAAAAARFLGFFQSYAVEVDIKDASNATCLYADWMMRFLIKYESNSGDYKTTTLNLSSSVTHNGSVCGNDTQAALVAVQFGEGHSWSINITKNNETYQGDFITLTYNTNDTAVFPDAKRKGPITVLVRDPSRPIQLNTVFVCHNSFVIEAENTTQIFWNVTMQAFVQNGTVSKKESRCPADTPTSEPTVPPTIANVTTASTTTLSPAPTTAPKPVENPVTGNYSLKSGNKTCFLATVGLQLNVSQEKPLLININPKTTVADGACGNTTATLKLNDGNSTLIGFTFAVKNTSASVQKFYLREVNVTLLNRLNGSVISSADNSNLSKWDAFLGSSYMCRKEQTLQINENVQVHTFNLWIQPFLVEANKFATAEECIADSDLNFLIPIAVGVALGFLIILVFISYIIGRRKSRTGYQSV

SEQ ID NO: 40 - protein, 408 aa, Xenopus tropicalis
MERCACPAALLLLSLVLMGAMAFDVEIKDDKNATCIYAKLSVNVTVQYETNTSSTKNVTFSVPSEVTTNGSSCGSNGKAPILVINFGNGHSWSLNFTRNDSMYSGGALIFTYNTNDSTLFPDALKEGLISSTAAFLGPIPLNSTYKCISSEVVVSENVTQIISDVKLEAFMQNGTLGKEVSCDADKPSPTPTTNPSTTASTTTPTPTSKPLDNPTTGNYSVSDVNGTCLLASMGLQINTSLLSEGKNIWTAFNIDPTAMSKNGTCSNQTGTLILTDNSTVIEFTLALKNKNHFYLKEVNVALINGSASSTRQNQNLSAWEASVGSSYMCHKEQQIKVSEDLVINSFDVRVQLFGVKNETFATAQQCSLDDDSIVIPIVVGAALAGLIVIIVIAYLIGRRKGYSGYQTL

SEQ ID NO: 41 - protein, 404 aa, Salmo salar
MFRCAFLILFLALGNELHLSHGTEVSVNNTENKLCLYANLMVNFSVTYEVGVNKNETVIFVLPENVTTEGSTCDNTTSTLKLSFGHGHSWTVEFTKKNKTYQVDTIVFSYNLNDSSVFPNSTSKETKFVTVKSIITNVSVDTYYSCKSENVLTVESVIQTLYDVALQAFVINGSKSDTDTVCSADMTSTTVAPTTTVTSTAAPTSTPTLPTPTTGKYSIAPDVNSTACLMATFGLQIGYKQGDKEETINLVPNITEVGGACGANSSDLILTSDTITIMFTFSNDGKKFHLHALKVTVKPATGDPVIAVNNNMSIWAAAVGSSYMCNKEQTLNVTDTLTLYTFELRVQPFEVNKGEFATAHECSLDDTSILIPIIVGAALAGLILIVVIAYVIGRRKTYVGYQTL

SEQ ID NO: 42 - protein, 410 aa, Oreochromis niloticus
MKVSHATAGLVVWFVVLGCIDAVTLEVKESNTTCIKADLSASFSIIYNTTHAERTVQVLLPNSTTVDTANSTCGKDGSSPRLVAVFGSGYTLGLNFSTNGTLYQVSSLTLQYNLSDTSVFPNATISGVVTLVSASVGIEANVNTTYKCASPTVIDVATAKVNFTDMRLEAYMPGNELSPNETVCFADQTSTTPSPTTVSTTAVPTQTPPGTPQQGNYTVKDANDTICLLAKMGLQLNVSYTSQNKTVQDVLNLNPNVTNSTGSCGASSATLVLTQTQSTILTFNFTLNSTTNKYHLSGVTLIANWFDSAHFSMSNNSLNYLRSTLGYSYMCNAEQTLFVTPSFSLNTFDLQVQPFGVKSGRFATAEECQMDQNQMIIPIIVGAALAGLVLITLIAYLIGKRRSHAGYQAI

SEQ ID NO: 43 - protein, 249 aa, Takifugu rubripes
MTQIGGVQPVFLAVTVHLILATVLHQTFATVTPPVTTAVPHKEPGRPDQGDYQVTSSNGTVCFLASMGLQLNITFNSTSQNKTLQEVINIQPNRTKSSGSCDTSSALLTLTTDAEKTNLTFVFALNTTSNKYHLSEVSLSAALSDMKETFVAQNHSLDYLRGTLGFSYMCRERQTLGVTPDFAINTFQVQVQPFGVTGKQFAAAEECQLDKDDMLIPIIVGAALAALVLIVLSAYLIGRKRSHAGYQSI

SEQ ID NO: 44 - protein, 418 aa, Pan troglodytes
MPRQLSAAAALFASLAVILHDGSQMRAKAFPETRDYSQPSAAATVQDIKKPVQQPAKQAPHQTLAARFMDGHITFQTAATVKTPTTTPATTKNTATTSPITYTLVTTQATPNNSHTAPPVTEVTVGPSLVPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVSWGHRTITLSSKSLSGGCLARNEHSPHPLFLFFEKGPPSVTQAEDEESYYISEVGAYLTVSDPETIYQGIKHAVVMFQTAVGHSFKCVSEQSLQLSAHLQLKTTDVQLQAFDFEDDHFGNVDECSSDYTIVLPVIGAIVVGLCLMGMGVYKIRLRCQSSGYQRI

SEQ ID NO: 45 - protein, 416 aa, Papio anubis
MPRQLSAAAVLFASLAVILHDGSQMRAKAFPKTRDYSQPTAAATGQDIAKPVQQPANQAPHQTLAARLMDGHITFQTAATIKTPTTTPVTTKNTPTTSPIIYTLVTTQATSNNSHTAPPLTKVTVGPSLAPYSLPPTITPPAHTTGTSSSTVNHTTGNATQPSNQTTLPATLSIALHKSTTGQKPVQPTHAPGTTAAAHNTTRTAAPASTVPGSTLAPQPSSVKTGIYQVLNGSRLCIKAEMGIQLIVQDKESVFSPRRYFNLDPNATQASGNCGTRNSNLLLNFQGGFVNLTFTKDEGSYYISEVGACLTVSDPETIYQGMKHAVVMFQTAVGHSFKCVSEQSLQLSAHLQLKTTNVQLQAFDFEDDHFGNVDECSSDYTIVLPVIGAIVVGLCLVGIGVYKIRLRCQSSGYQRI

SEQ ID NO: 46 - protein, 416 aa, Macaca mulatta
MPRQLSAAAVLFASLAVILHDGSQMRAKAFPKTRDYSQPTAAATGQDIAKPVQQPANQAPHQTLAARLMDGHITFQTAATIKTPTTTPVTTKNTPTTSPIIYTLVTTQATSNNSHTAPPLTKVTVGPSLAPYSLPPTITPPAHTTGTSSSTVNHTTGNATQPSNQTTLPATLSIAPHKSTTGQKPVQPTHAPGTTAAAHNTTRTAAPASTVPGSTLAPQPSSIKTGIYQVLNGSRLCIKAEMGIQLIVQDKESVFSPRRYFNLDPNATQASGNCGTRNSNLLLNFQGGFVNLTFTKDEGSYYISEVGACLTVSDPETIYQGMKHAVVMFQTVVGHSFKCVSEQSLQLSAHLQLKTTNVQLQAFDFEDDHFGNVDECSSDYTIVLPVIGAIVVGLCLVGMGVYKIRLRCQSSGYQRI

SEQ ID NO: 47 - protein, 428 aa, Canis lupus familiaris
MSWQLSAAVALFVSLALILHYGSQIRAKMFPETVDFQPTTAATVRATAKPFLHLTNQVPSQTLAARSMDGHIASQRAATTSSSEPPTTHTTVKTLVTTSLVTANSTPSSSPIIYTLVTTIVTPNNSNTAAPVTEATIGPSADPGSLPTTSTPLAHTTRTNPSTLSHKTRKTTHFGNQTTLPATLSTSTHKSTSSHKSAQSTHAPGPTTAAHNTTQTASPATPASGPTLAPQPSSPKTGIYQVLNGSRLCIKAEMGIELMVQDTKSVFSPQRYFNIDPNATQTSGNCGSQKSNLLLNFQGGFVNLTFLKDENSYYINEVGAYLAVSNPEKIYQGMKSSVVMFETGVGHSFKCVSEQSIQLSTHLQLKTMNVQFQAFDFEDDHFGNVDECSSDYTVVLPVIGAIVLGLCAVGLIVYGIHLRRESSGYQRI

SEQ ID NO: 48 - protein, 430 aa, Sus scrofa
MSWRLSAVLVSFVSLAVFLHYGHHMKAKVFPEITDSSSPTTAATVQATAEPSLWKPTNHTPHKTLAAKSTDGHVTSQIATTVTDSETLTTHTTITTLAATSLAATNSTPSTSPTTHTLFTTLATPNTSHMAAPVTEAAISPSAGLSSLLPTIIPPAHTTGTRSSTLSPTAGKTTQPSNQTTLPATLSTSPHNSTASQKPTHPNHTPGPTTGAHNTTQTASPATIAPGPTLAPQPSSAKTGIYQVLNGSKLCIKAEMGIELTVQDTQSVFSPQRYFNIDPNTTQASGNCGSRKSKLLLNFQGGFVNLTFTKDENSYYVSGVGAYLTVSNPEKVYQGMKNAVVMFETMIGHSFKCVSEQSIQLSPHLQLNTMNVQLQAFDFEDDHFGNVDECSSDYTIVLPVIGAIVLGLCAVGLIVYGIRLKRESSEYQRI

SEQ ID NO: 49 - protein, 259 aa, Danio rerio
MTQSSRSVLLLMLSSLHCLGSSLESNPKDPSVLAEAPGQNKRDSDISLVPQMPVLQPKETAPPLVTYTIRNPQGKVCVRASFGVEFVVRENKKKYYFNLTPNSARATGYCANQKTVLSLEFSGGNLEFTFIKDGDQSYVKTVKGSLRAAPPCKNCPSKIYVGLVDNEKLFKAKNGLSFNCKSETMLILADYFRLKLVPLQIQAFDLVNGAFGKEVECWADYNKRMIPIILGAVAAAICLIAILTYVLVREHRNQGYEQL

SEQ ID NO: 50 - protein, 432 aa, Equus caballus
MAWQLSAVVVLFVSLAVILYYGSHVRANVFPEITDYSQPTTAATIQTRAQPSLSQPTNQVPHKTLATRSMDGQVTSQTAATTVNPETPVTHTTIKTAAATSLVTTNSTLSTSPITNTLLTTLATPDNTHTTTPVTEATIGPSAGPGSPPTTITTTSSAYTTGTRSSTVSHTTGKTTQLSNQTTLPATLSTSPHNSTTSQNPAHSTHTPGPTTGTCNTTQTASPTTTAPGPTLAPQPSSAKTGMYQILNGSKLCIKAEMGIQLTVQDTKSASPPQGYFNIDPNTTQVSGICGSRKSNLLLNFWGGFVNLTFTKDENSYYISEVGAYLTVSNPEKTYQGMKSPVVMFETVIGHSFKCVSEQSLELSTQLHLKTTNVQLQAFDFEDDNFGNVDECSSDYTVVLPVIGAIVLGLFAVGLIVYGVRVRREASGYQRI

SEQ ID NO: 51 - protein, 433 aa, Bos taurus
MSWQIPAVVMSFMALVAIWYYDSHYNSHMQAKVFPEITGYSSPTTGQATVKPSLLQPTNYVPHKTAAARSTDGHVTSQTVAKTSSSETLTTNTTIDVLATTSPVTTKSTLPTTPTTHTLVTTLATPNKSHVTFPVTEAKVGLSVGPSSPPVTVNPTAHTTGNRPSTASHTTGKTTQLSNQTTLPATLSTSPHNITTSQKPTQPTHTPGPTTATYNTTQTASPATIAPRPTLAPQPLSPKTGIYQVHNGSKLCIKAEMGIQLTVQDSVSVFSPQKYFNIDPNATQASGNCGSRKSNLLLNFQGGFVNLTFTKGEKSYYISEVEAYLTVSNPAKVYQGLKHAMMMFETVVGHSFKCVSEQSIQLSTYLQLKTMNVQLQAFDFEDDHFGNADECISDRNRREIPVAVGLSIAVLLAVLLTACLVTRKRPSRGYERM

SEQ ID NO: 52 - protein, 429 aa, Ovis aries
MSWQISAVVLFFVSLAVIWYYDSHMKANVFPEITGYSSPTTGQATVKPSLLQPTNHVPCNTAAAKSTDGHVTSQTVAKTSSPETLTTNTTIEVLVTTSPVTTQSTLPTTPTTHTLVTTLATPSKSHVTFPVTEAKAGLSIGPSSPPVTINPAAHTTGNRPSTASHTTGKTTQLSNQTTLPATLSTSPHNITTSQKPTQPTHTPGPTTAANNTTHTASPATIAPRPTLAPQPLSPKTGLYQVLNGSKLCIKAEMGIQLTVQDSVSVFSPQKYFNIDPNATQASGNCGSRKSNLLLNFQGGFVNLTFIKDENSYYISEVEAYLTVSNPAKVYQGMKYAMMMFETVVGHSFKCVSEQSIQLSNHLQLKTVNVQLQAFDFEDDRFGNADECISDRNRREIPVAVGLSIAVLLAVLLTACLVTRKRPSRGYERM

SEQ ID NO: 53 - protein, 408 aa, Rattus norvegicus
MPGQTSAVAVLLCLAVILHGYQIREKEFPEARGYLQYTATTTEQITAKPPLPLTNQTSHATLASRSKDDYIQTAAETSTFEDTAHITMKTAIPVTTKSLLPISSTSYTFVRTNNSHMTASSTEDTIGSGSITHLPFPTTRASLAAVNHITGRSTQLGGQTTLPKALFTPSHESTTTQRPTLSTIVSELTPTGKDRSTTSSVPLVPRPTFVTWSSPAKIGTYEVLNGSRLCIKAEMGIALIVQEKGLDSATQRHFNIDPSLTHASGKCGSQNSNLFLNFQGGSVNVTFTKEENLYYVSEVGAYLTISNTEKTYQGKSTMMMFETVVGHSFKCVSEQSIQLSAQLQMKTMNIHLQAFDFEGDSFGIVDECLSDYTVVLPVVGIIVVVLCVVGLGIYKIRQRRQSSAYQRI

SEQ ID NO: 54 - protein, 411 aa, Mus musculus
MPGQISAVAVLFLSLTVILHGYQIREKEFPKARGYLQYTATSAEQITTKPLLQLINQRSHITLASRFKDDYIQMAAETSAIENTAHITMKTVTPVTTKSLPPISSASYTFVRSNNAHMTASSTDDTIGSGSIAHLPVPTTRASLAIVNYITGRATQLGGQTTLPKTFFTASHKSTTNQRPTLSTNVLGTSTPTHKDRSTTSPVPLVPRPTLVTWSSPAKIGTYEVLNGSRLCIKAEMGLALIVQEKDLDSATQRYFNIDPSLTHASGKCDSQKSNLFLNFQGGSVNITFTKEENLYYISEVGAYLTISNTEKTYQGKKNTLMMFETVVGHSFKCVSEQSIQLSAQLQMKTMNIHLQAFDFEGDSFGNVNECLSDYTVVLPMVAIIVVVICVVGLSVYKIRQRHQSSAYQRI

SEQ ID NO: 55 - protein, 314 aa, Xenopus tropicalis
MDRVSLLSTILLLYGLLYINDAYSENTFAQPSNTTTPAPNTTTTHVTSNTTTLAPNTTTTHVTSNTTTLAPNTTTTHITSNTTTLAPNTTTTLAPNTTTTHSVTTTKTASTTTPTPTLEPKPSPPETGNYTVKIKNEFCIEALMGLELELTNSTKTQQYFNIVPSQINSNGTCEKSKANLNLTFANSYINFVFAQDDNSYYLDNVTVYFNLTRSESWYGNATNQKLLKTENGYSVKCKNTPKIQLGDTMNLVMTNVKLQVFNFKDNSFGKETTCKYDHNFGLMIAGIVIVVIVVLGVIIYFIWHKRKSSGYQRI

SEQ ID NO: 56 - protein, 478 aa, Pan troglodytes
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVRFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNKEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 57 - protein, 478 aa, Macaca mulatta
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANVQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDNYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNKEDHETFVDINPLTGIILKAAKRFQINIYVKKLDDFVETGDIRTMVFPVMYLNESVLIDKETASRLKSVINTTLIITNIPYIIMALGVFFGFVFTWLACKGQGSMDEGTADERAPLIRT

SEQ ID NO: 58 - protein, 478 aa, Canis lupus familiaris
MGRCCFYTVGTLSLLLLVTSIALLVARVFQKAVDQTIEKNIVLRNGSETFDSWKKPPLPVYAQFYFFNVTNPEEILRGEIPRLEEVGPYTYRELRDKADIQFGDNGTTISAVSNKAYVFERNQSVGDPKTDLIRTLNIPAVTAMEWAHLHFFRELIEALLKAYQQTLFVTHTVDELLWGYKDEILSLINVFKPEISPYFGLYYGKNGTNDGDYVFLTGEDNYLNFSKIVEWNGKTSLDWWTTDKCNMINGTDGDSFHPLIDKDEILYVFPSEFCRSVYITFSDFKSVQGLPAFRYKVPGEVLANTSDNAGFCVPKGNCLGSGVLNISICKNGAPIIISFPHFYEADKKFVSAIDGMRPNKDYHETFVDINPLTGIILRAAKRFQINVYVKKLDDFIETGNIRTMVFPVMYINESVLIDKDTASRLKSVINTTLIITNIPYIVMALGVFFGLIFTWLACRGQGSMDEGTPDERAPLIRT

SEQ ID NO: 59 - protein, 478 aa, Bos taurus
MGRCCFYAVGTLSLLLLVTSITLLVARVFQKAVDQTIEKNIVLRNGSETFDSWKKPPLPVYTQFYFFNVTNPEEILNGETPRLEEVGPYTYRELRNKDDIQFGDNGTTISAVSNKAYVFERDKSVGDPKIDLLRTLNIPALTAMEWTQLPLLRDIIEALLKAYRQKLFVTHTVDELLWGYKDEILSLINTFKHDVSPYFGLFYGKNGTNDGDYVFLTGEDNYLNFSKIVEWNGKTSLDWWTADECNMINGTDGDTFHPLITRDEVLYVFPSDFCRSVYITFSDFESVQGLPALRYKVPAEILANTSDNAGFCIPKGNCLGSGVLNVSVCKNGAPIIMSFPHFYQADEKFVSAIGGMHPNKEYHETFVDINPLTGIILRAAKRFQINVYVRKLDDFVETGNIQTLVFPVMYINESVLIDKETASRLKSVINTTLIVTNIPYIIMALGVFFGLIFTWLACRGQGSTDEGTADERAPLIRT

SEQ ID NO: 60 - protein, 478 aa, Mus musculus
MGRCCFYTAGTLSLLLLVTSVTLLVARVFQKAVDQTIEKNMVLQNGTKVFNSWEKPPLPVYIQFYFFNVTNPEEILQGEIPLLEEVGPYTYRELRNKANIQFGENGTTISAVTNKAYVFERNQSVGDPNVDLIRTINIPLLTVVDLAQLTLLRELIEAMLKAYQQKLFVIHTVHELLWGYKDEILSLVHIFKPDVSPNFGLFYERNGTNDGEYVFLTGEDNYLNFSKIVEWNGKTSLDWWTTDTCNMINGTDGDSFHPLISKDEVLYLFPSDLCRSVHITFSSFENVEGLPAFRYKVPAEILANTSENAGFCIPEGNCMDSGVLNISICKNGAPIIMSFPHFYQADEKFVSAIKGMHPNKEEHESFVDINPLTGIILRGAKRFQINTYVRKLDDFVETGDIRTMVFPVMYLNESVLIDKETANQLKSVINTTLVVTNIPYIIMALGVFFGLVFTWLACRGQGSMDEGTADERAPLIRT

SEQ ID NO: 61 - protein, 531 aa, Danio rerio
MTRRSCTIYATGIVCAHLLILGIALLLAQVFQTMIQERIKKEITLAENSRVLDGWINPPPPVYMQYFFFNVTNPDEFLAGKEKAKVTQMGPYTYREYRPRENVTYLENGTKIFATNPKSFVFLRNMSAGDPEVDRVTTVNIPMIAVMNELNSYSFFVRTAVSMYMGSMGMGLFMNRTVHEILWGFKDPLLTKLHAMRPEVDEHFGLMYNKNGTHEGEFVFHTGEKNYMNYGKIDTWNGISQMNWWSSNQSNMINGTDGSVFHTFLSRKELLYIFAADLCRSIHLGYVRDMEVKGIPAFRFAPPSDVLAPPDENPANAGFCVPAGDCLGKGVLKVSVCRQGAPIVVSFPHFYQADERYINAIEGMNPNEEEHETYLDINPTTGVPIRACKRAQLNIILKRVRGFPNTKFLNETIFPIMYVNETATIDDESAAQMRMLLLIVTVVSNFPVIILALGVILLVVLIFLVCRNRQRKNEVKRIDFTEAFHSFATTKDETAYTQVSNQAEDSPENRNNQPLRNGSYIAMSPVEAQKC

SEQ ID NO: 62 - protein, 478 aa, Rattus norvegicus
MARCCFYTAGTLSLLLLVTSVTLLVARVFQKAVDQTIEKNMVLQNGTKVFDSWEKPPLPVYIQFYFFNVTNPEEILQGEIPLLEEVGPYTYRELRNKANVQFGENGTTISAVTNKAYIFERNQSVGDPTVDLIRTINIPLLTVVEMAQQPFLREIIEAMLKAYQQTLFVTHTVHELLWGYKDEVLSLVHIFRPDVSPNFGLFYERNGTNDGEYVFLTGEDNYLNFTKIVEWNGKTSLDWWTTDTCNMINGTDGDSFHPLISKDETLYIFPSDFCRSVYITFSSFENVEGLPAFRYKVPAEILANSSENAGFCIPEGNCMDAGVLNVSICKNGAPIIMSFPHFYQADEKFVSAIKGMRPNKEEHESFVDINPLTGIILRGAKRFQINTYVKKLDDFVETGNIRTMVFPVMYLNESVLIDKETASQLKSVINTTLIVTNIPYIIMALGVFFGLIFTWLACRGQGSTDEGTADERAPLIRT

SEQ ID NO: 63 - protein, 481 aa, Gallus gallus
MRSLCLVTVGVLALTLLIASISLLVAHVFQTVVDLQVKQGTVLKNGTETFEAWEDPPPPVYMQFYFFNVTNPLEVLQGATPLVEEKGPYTYREYRPRVHVQFLDNGTKVSALNPKTYVFEPEKSVGNPEVDLIRTINVPAVTAMEWTRATSLQFATEVLLLLYQESLFTVRTVHELLWGYKDKLLSTIHVLHPEIDPVFGFFNKMNGTDDGEYVFLSGEMNYLNFSRIVEWKGKESLNWWTTKTCNMINGTDGTSFHPLISKDENIYIFSSDFCRSLYLVYDSSGSVAGVPTYRFVPSPMVFANTTVNPDNAGFCVPPGNCPGAGVLNVSICKQGAPIFLSAPHFYQADQKFVSDIEGMHPTKEYHETFVDINPLTGLVLQAAKRMQINIHVRKLPEFFETGNIRTLIFPVMYINESVLIDEASANKLKHVLLEASVVTGIPFVIMAIGIVFGIVFSVLVCRAQGAREESTEEERSPLIRT

SEQ ID NO: 64 - protein, 483 aa, Xenopus tropicalis
MVKWAVFGTAAVSVTLLIVSIVLLLTHTFMDIVEGQVKQAIVLKNESEVFEDWANPPPPVYMQFYFFNVTNPLEVLSGEKPFVDEIGPYTYREYRPRENITFSVNGTEVSAVTPKTYVFEPEKSIGDPKVDLIRTVNIPLVTILEMTKDSSLLRPFIIAALKTYKEGMFVTRTVDELLWGYKDAVLSILHPFKKNISDTFGLFYKMNTTDDGEYIFLSGEKDYLEFTQIAEWKGQKALNWWTTETCNMINGTDGTSFHPLLNKDDTIYMFSSDLCRSIYAVYESSENIKDISVFRFSPPASVFANVSVNPQNKGFCVPEGNCLPSGLLNVSICKEGAPIVLSSPHFYQADENVINSIRGMKPVKEHHMTFLDLNPLTGTLIQAAKRIQVNVYVRKINVYLITQDIQTLFFPVMHLNESVLIDDKSAGRLRSILFQGRVVANIPFIIMGLGIILAFLFTTLSCLQKRSRDEGTEEERGPLIRAS

SEQ ID NO: 65 - protein, 551 aa, Drosophila melanogaster
MQLDDILHINNCKADCSSLSTTPNPKTDLVNMNGPKHKFCTKLSSTYLRKWWITIVVAAALIIGGIVVACEFTVLIDAVVDRMVALRPGAKTFGWWAKPPVEPRISLYIYNVTNADDFLSNGSKAIVDEVGPYVYSETWEKVNIVENDNGTLSYNLRKIYSFREDLSVGPEDDVVIVPNIPMLSATSQSKHAARFLRLAMASIMDILKIKPFVQVSVGQLLWGYEDPLLKLAKDVVPKEQKLPYEEFGLLYGKNGTSSDRVTVNTGVDDIRRYGIIDNFNGRTHLPHWTTDACNTLAGTDGSIFPPHIDHDRILHVYDKDLCRLLPLVFEKEVMTSNEVPGYRFTPPEWVFADVDSHPDNMCFCPAGKPSCSPNGLFNVSLCQYDSPIMLSFPHFYLADESLRTQVEGISPPMKEKHQFFFDVQPKMGTTLRVRARIQINLAVSQVFDIKQVANFPDIIFPILWFEEGIDNLPDEVTDLMRFAEQVPPKIRVALIVGLCALGVILLLLSTFCLIRNSHRQSTLHLEGSNYLATAQVDMNKKQNKDNQPARY

SEQ ID NO: 66 - protein, 522 aa, Anopheles gambiae str. PEST
MYGRSNRLCAKLSSAFLRKWWFVIAFALSLLVLGALVTFGFTAFIRTIIDHQVALRVGGQSFGWWSRPPVEPIIRIFVYNVTNADEFLNNGTKPILDELGPYVYVQTWEKVNIKENPNGTISYNQKRVYIFNEDLSGGLEDDVVIVPNIPMLSATSQSKHAARFLRLAMASIMDILKIKPFVEVSVGQLLWGYEDPLLKLAKDVVPKEQKLPYEEFGLMYGKNSTSKDTVTVWTGVDDITQYGIIDKYNGRSHQTHWLSEQCNRLNGTDGSIFPPRITKNSTLHVYEKDLCRLLPLSFEKEVTVRGGVKGYRFTPSPDVFASVDKNPNNMCYCPAGPPCAPHGLFNVSLCQYDSPILLSFPHFYMADQTLRTAVEGISPPEKDKHQLFIDVQPDMGTALRARARIQINLAVSQVVDIKQVANFPDIVFPILWFEEGIDSLPDEILDLMKVATNIPPRAKFILTIALFGLGGFLFVVAVICLVRKSHRQSTLHLEGSNYLATASVDQAKKKAKMDNGMSSKSN

SEQ ID NO: 67 - protein, 338 aa, Homo sapiens
MVRRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 68 - protein, 338 aa, Pan troglodytes; identical to SEQ ID NO: 67

SEQ ID NO: 69 - protein, 338 aa, Oryctolagus cuniculus
MGARVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 70 - protein, 341 aa, Mus musculus
MVGRVQPDRKQLPLVLLRLLCLLPTGLPVRSVDFNRGTDNITVRQGDTAILRCVVEDKNSKVAWLNRSGIIFAGHDKWSLDPRVELEKRHALEYSLRIQKVDVYDEGSYTCSVQTQHEPKTSQVYLIVQVPPKISNISSDVTVNEGSNVTLVCMANGRPEPVITWRHLTPLGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFSKYAKTEPDSMQVIEFLHIDLKSIRHPLKVNPIQK

SEQ ID NO: 71 - protein, 337 aa, Xenopus laevis
MVGRSQSDRNQLPLFLLRLLCLLPTGLPVRSGDFNRSTDNMTVRQGDTAILRCFVEDKSSKVAWLNRSGIIFAVDDKWSLDPRVELEKRSPFEYSLRIQKVDVSDEGPYICSVQTNQHTKTMQVYLIVQVPPKISNISADITVNEGSNVTLMCIAYGRPEPMITWRHLTPTARDFEGEEEFLEIQGITREQSGRYECKAANEVASADVKQVRVTVNYPPIITESNSNEATTGKQAILRCEASAVPAPDFEWYKDDTRINSAQGLEIRNTGSRSVLMVANVTEEHYGNYTCVAANKLGITNTSLYLYIGPGTPIDNATSLAASLWLMANILLCLFCTC

SEQ ID NO: 72 - protein, 333 aa, Danio rerio
MSCLWIHSVFIPGFFLLFGFEGFPVISVESQRSTDNITIRQGDTTVIRCYVDDKVSKVAWLNRSNIIFAGEDKWSLDPRVELVTQGQLEYSLRIQKVDVFDEGPYTCSIQTKQQSKTSQVYLIVQVPAIIYKVSEDITVNEGSNVALTCLANGRPDPAITWRLLNPSAEALDVGEYLEISGVVRSQAGRYECKASNDVSTPDVKYVNVVVNYPPYIKDVRSSETAVGQAGVLHCEASAVPQPEFEWYRDERRLSSSQSLTIQVSGSRTVLVVANVTEEDYGNYTCVATNRLGVHNASVFLYKPGMGRDINSAGCICQSLWLLLLCVSSALLQC

SEQ ID NO: 73 - protein, 197 aa, Mus musculus
MSGSSRRLLWAATCLAVLCVSAAQPNITTLAPNVTEVPTTTTKVVPTTQMPTVLPETCASFNSCVSCVNATFTNNITCFWLHCQEANKTYCANEPLSNCSQVNRTDLCSVIPPTTPVPTNSTAKPTTRPSSPTPTPSVVTSAGTTNTTLTPTSQPERKSTFDAASFIGGIVLVLGVQAVIFFLYKFCKSKERNYHTL

SEQ ID NO: 74 - protein, 197 aa, Macaca mulatta
MSRLSRSLLWAVTCLAVLCVLSAEENPTPHTNVTSLAPTSNITSAPVTSLPLVTTPAPETCEGRNSCVSCFNASTVNTTCFWIECKDESYCSHNSTVSDCQVGNTTDFCSVPTATLVPTANSTAKPTVQPSPSTTSKTVTTSGTTNTTVTPTSQPVRKSTFDAASFIGGIVLVLGVQAVIFFLYKFCKSKERNYHTL

SEQ ID NO: 75 - protein, 194 aa, Sus scrofa
MLGLSRQLLWAVGCLAALCVLTAAKNSTILPPSTTTPWLSPPTTQTTSAPPKTLPTPAPEICENRNSCISCFDANNTCFWIECKGKSYCSDNSTVSDCHVVNGTDFCSGPTVTPLPTNSTAKTTTLPSPSSASTTATTSGTTNTTLAPTTQPMRKSTFDAASFIGGIVLVLGVQAVIFFLYKFCKSKERNYHTL

SEQ ID NO: 76 - protein, 198 aa, Bos taurus
MSGLSRPLLLAVGCLAALCVITAAGNTTLAPNVTTASSPPPTTTTVPVSPTTLSPLPVTTPAPDICGSRNSCVSCVDGNATCFWIECKGKSYCSDNSTAGDCKVVNTTGFCSVPTTTPTPTNSTAKTTTLPSTTTTSTTATTSGTTNTTLSPTIQPTRKSTFDAASFIGGIVLVLGVQAVIFFLYKFCKSKERNYHTL

SEQ ID NO: 77 - protein, 198 aa, Ovis aries
MSGLSRPLLLAVGYLAALCVITAARNTTVTPNVTTPSSPPPTTATVPVSPTTLTPPPVTTPAPDICGSRNSCISCVDGNATCFWIECKGKSYCSDNSTVSDCKVVNTTGFCAVPTTTPTPTNSTAKTTTLPSTTTTSTTATTSGTANTTLTPTIQPMRKSTFDAASFIGGIVLVLGVQAVIFFLYKFCKSKERNYHTL

SEQ ID NO: 78 - protein, 198 aa, Canis lupus familiaris
MSGLSRQLCWAAACLAALCALTAAQSFSSDPNGTTTTTQATTDAATTRVTTAAPATTPAPDPCDNRNSCVSCVNTSVDATACSWIECKEKSYCSHNTTVSDCQVVNSTQLCSAPEPTMMPTNSTAKTTTQPSSSTATTTATTSGTTNITLSPTSQPGRKSTFDAASFIGGIVLILGVQAVIFFLYKFCKSKERNYHTL

SEQ ID NO: 79 - protein, 195 aa, Rattus norvegicus
MSGASRGLFWAATCLAALCLSAAQSNSSASPNVTDPPTTTSKVVPTTLTTTKPPETCESFNSCVSCVNATLTNNITCVWLDCHEANKTYCSSELVSNCTQKTSTDSCSVIPTTPVPTNSTAKPTTRPSSPTPTPSVVTSAGATNTTVTPTSQPERKSTFDAASFIGGIVLVLGVQAVIFFLYKFCKSKERNYHTL

SEQ ID NO: 80 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 81 - protein, 354 aa, Pan troglodytes
MRLAVLFSGALLGLLAAQGTGNDCPHKKSATLLPSFTVTPTVTESTGTTSHRTTKSHKTTTHRTTTTGTASHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKAVYLSYMAVEYNVSFPHAAQWTFSAQNASLRDLQAPLGRSFSCSNSSIILSPAVHLDLLSLRLQAAQLPHTGVFGQSFSCPSDRSILLPLIIGLILLGLLALVLIAFCIIRRRPSAYQAL

SEQ ID NO: 82 - protein, 335 aa, Bos taurus
MRLAVFFSGALLGLLAAQGTGNDCPHKKSATLLPSFTVTPTATESTPSPGTTSHRTTKSHRTTTWRISTTTHTTNTTGTTSSESPTATHSPATTTSHQNTTVHPTSNITATSPGPSTRSPHPEPPPSPSPSPGSKEAIGDYTWSNGSQPCVRLQAQIQIRVLYPTQGGGEAWGISVLNPNRTKAQGGCEGTHSHLLLSFPSGQLSFGFKQDPLQSAVYLNYMAVEYNVSFPQAVQWTFSVQNSSLRDLQTPLGHSFSCRNASIIVSPALHLDLLSLKLQAAQLSPSGAFGPSFSCPNDKSILLPLIIGLILLGLLTLVLVTFCIIRRRPPTYQPL

SEQ ID NO: 83 - protein, 335 aa, Mus musculus
MRLPVCLILLGPLIAQGTEEDCPHKKAVTLLPSFTMTPTATESTASPTTSHRPTTTSHGNVTVHTSSGPTTVTHNPATTTSHGNATISHATVSPTTNGTATSPRSSTVGPHPGPPPPSPSPRSKGALGNYTWANGSQPCVQLQAQIQIRILYPIQGGRKVKLKWGLKRAWGISVLNPNKTKVQGGCDGTHPHLSLSFPYGQLTFGFKQDLHQSPSTVYLDYMAVEYNVSFPQAAQWTFMAQNSSLRELQAPLGQSFCCGNASIVLSPAVHLDLLSLRLQAAQLPDKGHFGPCFSCNRDQSLLLPLIIGLVLLGLLTLVLIAFCITRRRQSTYQPL

SEQ ID NO: 84 - protein, 354 aa, Macaca mulatta
MRLAVLFLGALLGLLAAQGTGNDCPHKKSATLLPSFTVTPTATESTGTTSHRTTKSHKTTTHRTTTTGTTSHRPTTATHNPTTTSHRNATVHPTSNSTATSQGPSTATHRPATTSHGNATVHPTSNSTATSPGLTSSAHPGPPPPSPSPSPASKETIGDYMWTNGSQPCVHLQAQIQIRVMYTTQGGGEAWGISVLNPNKTKVQGSCEGAHPHLLLSFPYGHLSFGFMQDLQQRVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLVLLGLLALVLIAFCIVRRRPSAYQAL

SEQ ID NO: 85 - protein, 330 aa, Rattus norvegicus
MRFPVCLTLLVLLVAQGTGKDCPHKKAATLLPSFTETPTTTGSTASPTTTHRPTTTSHRPTTTSHRPTTTSHRPTTTSHRPTTTSHRPTTTSHGNATVSPTTNSPGFSTVGPHPGPPPPSPSPSPSSTGALGNYTWTNGSQPCVQLQAQIQIRILYLTQGGKKAWGLSVLNPNKTKVQGGCDSAHPHLALSFPYGQLTFGFKQDRHQSHSTVYLNYMAVEYNVSFPQAAQWTFSAQNSSLQELQAPLGQSFCCGNTSIVLSPAIHLDLLSLRLQAAQLPDKGHFGPCFSCASDQSLLLPLIIGLVLLGLLTLVLIAFCVTRRRQSTYQPL

SEQ ID NO: 86 - protein, 329 aa, Canis lupus familiaris
MRPAVFFLGALVGLLAAQGTRSDCPHKKSATLLPSFTVTPTATESTGSPGTTSHSTTTAETTSHAPNTTTHQAPTTPGHRNTTIHPTTSNSTSNTTGTTGTGKPHTSTSYTQPGPGPRPPPPSPGPGPQDAIGDYTWTTGSQPCARLQARIQIGVVYPTQAGGQAWGISVLNPNSTKPWGDCDGARPHLLLSFPFGQLSFGFTQEPQQGSVYLDYLALQYNVSFPQAAQWTFSGQNASLRALQAPLGQSFSCRNASILLTPALRLDLLHLKLQAAQLPPSGAFGPSFSCPSEHFNLLPLIVGVISLGLLALALVTFCIIRRRPPTYQPL

SEQ ID NO: 87 - protein, 322 aa, Equus caballus
MRLAVLFSGALLGLLAAQETGNDCPHKKSATLLPSFTVTPTATESTASPGTTSHQTTQSHRTTTTGTTSDHPTTATHNPTTTSHGNTTVHPTTSNSTVTSPGSASSSPHPRPPPPSPSPSPGSKEAIGDYIWTNGSQPCVRLQAQIQIRVLYPTLGGGKAWGISVLNPNKTKAQGGCAHPHLLLSFPYGQLSFGFKQEPLQSTVYLNYIAVEYNVSFPQAAQWTFLVQNSSLRDLQAPLGQRFSCRNASIALSPAFHLDLLSLKLQAAQLTPTGAFGPSFSCPSDQSILLPLIIGLILLGLFALVLITFCVIRRRPPTYQAL

SEQ ID NO: 88 - protein, 305 aa, Oryctolagus cuniculus
MRLPVLFLALLGLHAASSGTTSHRTTKNPHTTSHSTATPGTTSHRPTTATPTTGHGNVTVHPTTSNTTSNTTTTTGTSPGFSTSTPHPGPPPPPPSPSPGSREAVGNYTWTNGSQPCVQLQAQIQIRVLYPTQGGGQAWGMSVLNPNRTKAQGGCEGPRPHLLLSFPYGQLSFGFKQDPGQGQSAVYLSYLAVEYNVSFPQAARWTFSAQNASLRDLQAPLGQSFSCRNASIAVSPALHLDLLSLRVQAAQLPRTGIFGPSFSCPADHPSILVPLIIGLILVGLLALVLVAFCIARRRPSAYQAL

SEQ ID NO: 89 - protein, 291 aa, Sus scrofa
MTLAVLFLGALLGLLAESTTSHRTTTPRTTTTGTTSHGPTTVTHNPATTTSHGNATVHPTSSSTATSPGSSTRPPHPGPPPPSPSPSPGSQEAIGDYTWTNGSQPCVQLQAQIQIRVLYPTQGGGEAWGISVLNPNKTKALGGCEGAHPHVRLSFPYGQLTFGFKQQPQESTVYLNYMAVEYNVSFPRAAQWTFSVQNSSLRDLQTPVGRSYSCRNASIILSTAFHLDLLSLKLQAAQLPPTGNFGPSFSCPSDQTILLPLIIGLIFLGLLILVLVTFCIIRRRPPAYQPL

SEQ ID NO: 90 - protein, 354 aa, Papio anubis
MRLAVLFSGALLGLLAAQGTGNDCPHKKSATLLPSFTVTPTATESTGTTSHRTTKSHKTTTHRTTTTGTTSHRPTTATHNPNTTSHRNATVHPTSNSTATSQGPSTATHRPATTSHGNATVHPTSNSTATSPGLTSSAHPGPPPPSPSPSPASKETIGDYMWTNGSQPCVHLQAQIQIRVMYTTQGGGEAWGISVLNPNKTKVQGSCEGAHPHLLLSFPYGHLSFGFMQDLQQRVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLVLLGLLALVLIAFCIVRRRPSAYQAL

SEQ ID NO: 91 - protein, 323 aa, Monodelphis domestica
MRLSLLLSGILLGLLAEQGAGDKCPQEKSVTLVPSFTVTTIATERSTTSPETTTSSGSTATTYRTSTAATTPHSNSTATSYSTTSEGTAVTHGTTTSPRNTSTTSTSQSVPVPPSPQPTSSPSGAVGDYIGANGSQLCVHLRAQIQMRVLYQASGGGKLWGIFVLNPNRTMAQGNCEANHSSLILSFPNGKLIFGFKQDSIKKIVYLSHLATEFNVSFPSATRWIFSVENSSLQDLQTPLGHSFSCRNRSIALSPDIHLDLLSLQLQAAQLSSSGAFGAAFSCSADLNILVPLVVGLVLLTLLILVLSAFCISRRRPPAYQPL

SEQ ID NO: 92 - protein, 263 aa, Ornithorhynchus anatinus
MGLTLPLPAQGSQCRANCPHKKSATLVPSFTVTPTATSGPTTTAHQTTTDHGTTTSHETTTSQGTSTHGTSTPHTTTTGHGTTTGHQNTSHSTTTSHGTSTPHKTTTRHPTTSHGTTTSHGTSTGHWTARPTIRPGPPPPPPSPGKAVGNYTVFNGSQPCLRLRAEIRLWVLYQAQEEGEAPPVSGAASFPPPRPRPVAGEGDGERSRVTPVASAMTVEGGSRAGFAMLGAEVRSRAPSLGRAGKTRLRIHQPVVVLQHTYYV

SEQ ID NO: 93 - protein, 280 aa, Homo sapiens
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 94 - protein, 280 aa, Pan troglodytes
MDLRGRAVPSIDRLRVLLMLFHTMAQIMAEQEVENLSGLSTNPEKDIFVVRENGTTCLMAEFAAKFIVPYDVWASNYVDLITEQADIALTRGAEVKGRCGHSESELQVFWVDRAYALKMLFVKESHNMSKGPEATWRLSKVQFVYDSSEKTHFKDAVSAGKHTANSHHLSALVTPAGKSYECQAQQTISLASSDLQKTVTMILSAVHIQPFDIISDFVFSEEHKCPVDEREQLEETLPLILGLILGLVIMVTLAIYHVHHKMTANQVQIPRDRSQYKHMG

SEQ ID NO: 95 - protein, 280 aa, Macaca mulatta
MDLQGRAVPSVDRLRVLLMLFHTMAQIMAEQEVENLSGLSTNPEKDIFVVRENGTTCLMAEFAAKFIVPYDVWASNYVDLITEQADIALTRGAEVKGRCGHSESELQVFWVDRAYALKMLFVKESHNTSKGPEATWRLSKVQFVYDSSEKTHFKDAVSAGKHTANSHHLSALVTPAGKSYECQAQQTISLASSDPQKMVTMILSAVHIQPFDIISDFVFSEEHKCPVDEREQLEETLPLILGLILGLVIVVTLTIYHVHHKMTANQVQIPRDRSQYKHMG

SEQ ID NO: 96 - protein, 280 aa, Canis lupus familiaris
MDLRGRAFPSVYRLRVLLMLFYTMARITAEQEVENLSGLSTNPEKDIFVVRENGTTCLMAEFAAKFIVPYDVWASNYVDLITEQADISLTRGAEVKGHCGHNESELQVFWVDRAYALKMLFVKESRNASKGPEATWRLSKVQFVYDSSEKTHFKDAVSAGKHTANSHRLSALVTPAGKSYECQAQQSISLASSDPQKTVTMILSAVHIQPFDIISDFVFSEEHKCPVDEREQLEETLPLILGLILGLVIVVTLAIYHIHHKMTANQVQIPRDRSQYKHMG

SEQ ID NO: 97 - protein, 280 aa, Bos taurus
MDLRRRALLGVDGLRVLLMLFHTVTRIMAEQEVENLSGLSTNPEKDIFVVRENGTTCLMAEFAAKFIVPYDVWASNYVDLITEQADISLTRGAEVKGHCGHDESELQVFWVDRAYALKMLFLKESHNTPKGPEATWKLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIVVTLVIYHIHHKMTANQVQIPRDRSQYKHMG

SEQ ID NO: 98 - protein, 280 aa, Mus musculus
MDLRVRTLLGGDRLRILLMFFHVMVQTVAEQEVENLSGLSTNPEKDIFVVRENGTTCLMAEFAAKFIVPYDVWASNYVDLITEQAEISLTRGAEVKGHCGHNESELEVFWVDHAYTLRMLFVKESHNTSKGPEATWNLNKVHFVYDSSEKTHFKAPVKVNKYIASSHHLSALVTPAGMSYECQAQQTISLASSDPQKTVTMILSAVHIQPFDIISDFVFSEEHKCPVDEQEQLEETLPLILGLILGLVIVITLVIYHIHHKMTANQVQIPRDRSQYKHMG

SEQ ID NO: 99 - protein, 280 aa, Rattus norvegicus
MDLRGRALLGGDRLRILLMFFHAMAQTVAEQEVENLSGLSTNPEKDIFVVRENGTTCLMAEFAAKFIVPYDVWASNYVDLITEQAEISLTRGAEVKGRCGHNESELQVFWVDRAYTLKMLFVKESHNTSKGLEATWKLSKVQFVYDSSEKTHFKDAVSAGKHTANSHHLSALVTPAGMSYECQAQQTISLASSDPQKTVTMILSAVHIQPFDIISDFVFSEEHKCPVDEREQLEETLPLILGLILGLVIVITLVIYHIHHKMTANQVQIPRDRSQYKHMG

SEQ ID NO: 100 - protein, 299 aa, Gallus gallus
MAAGRLPGLLFLLHAAARLAAEQEVENLSGLSPNPEKDIFVVRENRTTCLMAEFAAKFVVPYDVWASNYVDLITEQADIPLSRGAEMKGKCGTNESELEISWLERAYTLKLFFLKVRGCPRRLGRGRCAAALRGPDQPCPPQEGHNTSRGPEAFWRLSRIQFSYDTSERTYFKDAVSPGKHTASSHRLSALVTPAGKSYECQAQQTISLISSDHQKSVQLLLSEVRIQPFDITADFVFSEEHKCPVDQREQLEETLPLILGLILGLVIVITLCVYHIHHKLTANQVQIPRDRSQYKHMG

SEQ ID NO: 101 - protein, 276 aa, Xenopus tropicalis
MDYRACTSALRMPVLLLLLCTFSCNLAEQEVENLSGLSSNPDKNIFAIRENGTTCLMAEFSARILVPYEVPSSNEVDWDLEEASIQLPRDTEIRGKCWNNESELHLSWLDKAYTLKLFFSKEGQDASKSRSWKMSKIQFLYDPSEHTIFKSGARPGRHTANSHHLSLMVTPAGMSYECEATQRISLTSTDHQKIVVLYLSEVHLQPFDIKSDFVYSEEYKCPTDQRKQLEETLPLILGLTLGVAILIIVAVYHIHHKMTANQVQIPRDRSLYKHMG

SEQ ID NO: 102 - protein, 338 aa, Rattus norvegicus
MVGRVQPDRKQLPLVLLRLLCLLPTGLPVRSVDFNRGTDNITVRQGDTAILRCVVEDKNSKVAWLNRSGIIFAGHDKWSLDPRVELEKRHALEYSLRIQKVDVYDEGSYTCSVQTQHEPKTSQVYLIVQVPPKISNISSDVTVNEGSNVTLVCMANGRPEPVITWRHLTPLGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLFCLLSKC

SEQ ID NO: 103 - protein, 338 aa, Equus caballus
MVGRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRITSANGLEIKSTEGQSSLTVANVTEEHYGNYTCVAANNLGVTNASLVLFRPGSVRGINGSISLAVPLWLLAASLLCLLSKC

SEQ ID NO: 104 - protein, 338 aa, Sus scrofa
MVARVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGRELEGEEEYLEILGITREQSGKYECKAANEVSSADVKQVKVTVNYPPTITESKSNEATTGRKASLKCEASAVPAPDFEWYRDDTRINSANGLEIKSTEGQSSLTVTNVTEEHYGNYTCVAANNLGVTNASLVLFRPGSVRGINGSISLAVPLWLLAASLLCLLSKC

SEQ ID NO: 105 - protein, 338 aa, Bos taurus
MVARVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRKASLKCEASAVPAPDFEWYRDDTRINSANGLEIKSTEGQSSLTVTNVTEEHYGNYTCVAANNLGMTNASLVLFRPGSVRGINGSISLAVPLWLLAASLLCLLSKC

SEQ ID NO: 106 - protein, 417 aa, Anopheles gambiae str. PEST
MSFAGEAASQILNKAEPLFISRSEAFKFAVGDTITLPCEVASPGTYVLAWKRGIAILTAGSVKVTPDPRVRLVNGYSLQIRDAVPQDAGDYICQIAMLDPREITHSVEILVPPKITHVTSGGHLQVRKGSPVRLECSATGNPMPNITWTRKNNLLPNGEEQFTNPVYVIENMDRHKGGTYICTANNGVGQVATSQIILHVLYPPEISVENPTVYSGEGQEAMLVCIVHGESQPEVLWHKDTMQIDQTERHVIENRGARHTLIIRKVHPQDFGNYSCIADNQLGKTRKTVTLTGKPKTAVFRSVPNSQWKDKYNISWIVDSHSPIEEFKLYYRQMTFSIGQLQPLQTDWRDIVLPAFPYSHHYTQGMSYLIRGLEPDQQYEARVQSRNRYGWSDFSESFLFTTSNTGKWMGQCCTNPG

SEQ ID NO: 107 - protein, 334 aa, Xenopus tropicalis
MRPCLLHSIWMLGFVLCLLSLQGLPVRSGDFNRSTDNITVRQGDTAILRCFVEDRSSRVAWLNRSGIIFAGDDKWSLDPRVELEKRSLLEYSLRIQKVDVSDEGPYTCSVQTKQHTKTTQVYLIVQVPPKISNISADITVNEGSNVTLMCIAYGRPEPMITWRHLTPTARDFEGEEEFLEIQGITREQSGRYECKAANEVASADVKQVRVTVNYPPIITESKSNEATTGKQAILRCEASAVPAPDFEWYKDDTRINSAQGLEIRNTGSRSVLMVANVTEEHYGNYTCVAANKLGITNTSLYLYIGPGTPIDSATSLAASLWLMANLLFCLFCTC

SEQ ID NO: 108 - protein, 338 aa, Canis lupus familiaris
MLGARRPPRSQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVRQVKVTVNYPPTITESKSNEATTGRKASLKCEASAVPAPDFEWYRDDTRINSANGLEIKSTEGQSSLTVTNVTEEHYGNYTCVAANNLGVTNASLVLFRPGSVRGINGSISLAVPLWLLAASLLCLLSKC

SEQ ID NO: 109 - protein, 338 aa, Monodelphis domestica
MVGRVHPDRKQLPLVLLRLLCLLPTGLPVRGVDFTRGTDNITVRQGDTAILRCYVEDKSSKVAWLNRSGIIFAGHDKWSLDPRVELEKRTALEYSLRIQKVDVYDEGSYTCSVQTQHQPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSIEGQSLLMVTNVTEEHYGNYTCVAANKLGVTNASLILFRPGSVRGINGSISLAVPLWLLAASLFCLLSKC

SEQ ID NO: 110 - protein, 338 aa, Gallus gallus
MVARAQPDRKQLPLVLLRLLCLLPTGLPVRSVDFTRGTDNITVRQGDTAILRCFVEDRSSKVAWLNRSGIIFAGEDKWSLDPRVELEKRSPLEYSLRIQKVDVYDEGSYTCSVQTQHHPKTSQVYLIVQVPPKISNISSDITVNEGSNVTLVCMANGRPEPVITWRHLTPTGKEFEGEEEYLEILGITREQSGKYECKAANEVASADVKQVRVTVNYPPTITESKSNEAATGRQALLRCEASAVPTPDFEWYRDDTRINSANGLEIKSTGSQSLLMVANVTEEHYGNYTCVAANKLGVTNASLYLYRPGTGRVDNGSVSLAVPLWLLAASLLCLLSKC

SEQ ID NO: 111 - protein, 335 aa, Taeniopygia guttata
MRTYWLHSIWVLGFFLSLFSLQGLPVRSVDFTRGTDNITVRQGDTAILRCYVEDRSSKVAWLNRSGIIFAGEDKWSLDPRVELEKRNPLEYSLRIQKVDVYDEGSYTCSVQTQHHPKTSQVYLIVQVPPKISNISSDITVNEGSNVTLVCMANGRPEPVITWRHLTPTGKEFEGEEEYLEILGITREQSGKYECKAANEVASADVKQVRVTVNYPPTITESKSNEAATGRQALLRCEASAVPTPDFEWYRDDTRINSANGLEIKSTGSQSLLMVANVTEEHYGNYTCVAANKLGVTNASLYLYRPGTGRVDNGSMSLAVPLWLLAASLLCLLSKC

SEQ ID NO: 112 - protein, 334 aa, Xenopus tropicalis; identical to SEQ ID NO: 107

SEQ ID NO: 113 - protein, 337 aa, Oreochromis niloticus
MQVGRKSCWRQLQASFFRLLCLIPTGFPVRSVDMQRATDNITIRQGDTAIIRCYVDDKVSKVAWLNRSNIIFAGQDKWSLDPRVDLVTKGQLEYSLRIQKVDVYDEGSYTCSIQTKQQPKTSQVYLIVQVPASIYQVSNDITVNEGSNVTLSCLANGRPDPAITWRLLNPSAEPLDGEEYLDIIGIMRTQAGRYECKASNDVATPDVKYVNVIVNYPPTIKKTQSSETPVGRNGTLRCEVTAVPTPEFEWYRDDKRLANTQSITIQTSGTTTSLTIANITEEDYGNYTCVASNRLGVQNASLFLYRPGTGRDINGSACVSQSLWLLLASFACLFLKC

SEQ ID NO: 114 - protein, 561 aa, Artificial Sequence
  Synthetic Construct
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMAGASTSAGRKRKSASSATACTSGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRG

SEQ ID NO: 115 - protein, 146 aa, Artificial Sequence
  Synthetic Construct
LLQTGIHVRVSQPSLGPGPGALPLKMLNIPSINVHGPGPGDQYVKVYLESFCEDVGPGPGIIKPGKISHIMLDVAFTSHGPGPGPQYSEHPTFTSQYRIQGKLGPGPGPPWQAGILARNLVPMVGPGPGKYQEFFWDANDIYRIFA

SEQ ID NO: 116 - protein, 146 aa, Artificial Sequence
  Synthetic Construct
LLQTGIHVRVSQPSLPMGLPALPLKMLNIPSINVHPMGLPDQYVKVYLESFCEDVPMGLPIIKPGKISHIMLDVAFTSHPMGLPPQYSEHPTFTSQYRIQGKLPMGLPPPWQAGILARNLVPMVPMGLPKYQEFFWDANDIYRIFA

SEQ ID NO: 117 - protein, 906 aa, Human herpesvirus 5
  misc_feature: Strain AD169
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVYISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 118 - protein, 863 aa, Human herpesvirus 5
  misc_feature: Strain AD169
VSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVYISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 119 - protein, 79 aa, Artificial Sequence
  Synthetic Construct
TTSAQTRSVYSQHVTGPGPGQLIPDDYSNTHSTRYVGPGPGVSVFETSGGLVVFWQGPGPGNSAYEYVDYLFKRMIDLS

SEQ ID NO: 120 - protein, 79 aa, Artificial Sequence
  Synthetic Construct
TTSAQTRSVYSQHVTPMGLPQLIPDDYSNTHSTRYVPMGLPVSVFETSGGLVVFWQPMGLPNSAYEYVDYLFKRMIDLS

SEQ ID NO: 121 - protein, 491 aa, Human herpesvirus 5
  misc_feature: Strain AD169
MESSAKRKMDPDNPDEGPSSKVPRPETPVTKATTFLQTMLRKEVNSQLSLGDPLFPELAEESLKTFEQVTEDCNENPEKDVLAELVKQIKVRVDMVRHRIKEHMLKKYTQTEEKFTGAFNMMGGCLQNALDILDKVHEPFEEMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMAYAQKIFKILDEERDKVLTHIDHIFMDILTTCVETMCNEYKVTSDACMMTMYGGISLLSEFCRVLCCYVLEETSVMLAKRPLITKPEVISVMKRRIEEICMKVFAQYILGADPLRVCSPSVDDLRAIAEESDEEEAIVAYTLATAGVSSSDSLVSPPESPVPATIPLSSVIVAENSDQEESEQSDEEEEEGAQEEREDTVSVKSEPVSEIEEVAPEEEEDGAEEPTASGGKSTHPMVTRSKADQ

SEQ ID NO: 122 - protein, 156 aa, Artificial Sequence
  Synthetic Construct
VLAELVKQIKVRVDMVRHRIKEHMLKKYTQGPGPGIVPEDKREMWMACIKELHGPGPGKDELRRKMMYMCYRNIEFFTKNSAFPKTTGPGPGSVMKRRIEEICMKVFAQYIGPGPGAIAEESDEEEAIVAYGPGPGVKSEPVSEIEEVAPEEEEDG

SEQ ID NO: 123 - protein, 156 aa, Artificial Sequence
  Synthetic Construct
VLAELVKQIKVRVDMVRHRIKEHMLKKYTQPMGLPIVPEDKREMWMACIKELHPMGLPKDELRRKMMYMCYRNIEFFTKNSAFPKTTPMGLPSVMKRRIEEICMKVFAQYIPMGLPAIAEESDEEEAIVAYPMGLPVKSEPVSEIEEVAPEEEEDG

SEQ ID NO: 124 - protein, 79 aa, Human betaherpesvirus 5
MLSVMVSSSLVLIVFFLGASEEAKPATTTTIKNTKPQCRPEDYATRLQDLRVTFHRVKPTLVGHVGTVYCDGLSFPRVG

SEQ ID NO: 125 - protein, 54 aa, Artificial Sequence
  Synthetic Construct
ATTTTIKNTKPQCRPEDYATRLQDLRVTFHRVKPTLVGHVGTVYCDGLSFPRVG

SEQ ID NO: 126 - protein, 354 aa, Human betaherpesvirus 5
MTPTTTTAELTTEFDYDEDATPCVFTDVLNQSKPVTLFLYGVVFLFGSIGNFLVIFTITWRRRIQCSGDVYFINLAAADLLFVCTLPLWMQYLLDHNSLASVPCTLLTACFYVAMFASLCFITEIALDRYYAIVYMRYRPVKQACLFSIFWWIFAVIIAIPHFMVVTKKDNQCMTDYDYLEVSYPIILNVELMLGAFVIPLSVISYCYYRISRIVAVSQSRHKGRIVRVLIAVVLVFIIFWLPYHLTLFVDTLKLLKWISSSCEFERSLKRALILTESLAFCHCCLNPLLYVFVGTKFRQELHCLLAEFRQRLFSRDVSWYHSMSFSRRSSPSRRETSSDTLSDEVCRVSQIIP

SEQ ID NO: 127 - protein, 191 aa, Artificial Sequence
  Synthetic Construct
MTPTTTTAELTTEFDYDEDATPCVFTDVLNQSKPVTTWRRRIQCSGDDHNSLEIALDRYYAIVYMRYRPVKQTKKDNQCMTDYDYLEVSYPRISRIVAVSQSRHKGRIVRDTLKLLKWISSSCEFERSLKRGTKFRQELHCLLAEFRQRLFSRDVSWYHSMSFSRRSSPSRRETSSDTLSDEVCRVSQIIP

SEQ ID NO: 128 - protein, 327 aa, Homo sapiens
MLPRVGCPALPLPPPPLLPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNQRGECWCVNPNTGKLIQGAPTIRGDPECHLFYNEQQEARGVHTQRMQ

SEQ ID NO: 129 - protein, 175 aa, Human cytomegalovirus
  misc_feature: Strain AD169
MLSVMVSSSLVLIVFFLGASEEAKPATTTIKNTKPQCRPEDYATRLQDLRVTFHRVKPTLQREDDYSVWLDGTVVKGCWGCSVMDWLLRRYLEIVFPAGDHVYPGLKTELHSMRSTLESIYKDMRQCPLLGCGDKSVISRLSQEAERKSDNGTRKGLSELDTLFSRLEEYLHSRK

SEQ ID NO: 130 - protein, 150 aa, Artificial Sequence
  Synthetic Construct
ATTTIKNTKPQCRPEDYATRLQDLRVTFHRVKPTLQREDDYSVWLDGTVVKGCWGCSVMDWLLRRYLEIVFPAGDHVYPGLKTELHSMRSTLESIYKDMRQCPLLGCGDKSVISRLSQEAERKSDNGTRKGLSELDTLFSRLEEYLHSRK

SEQ ID NO: 131 - protein, 176 aa, Human cytomegalovirus
  misc_feature: Strain Merlin
MKPLVMLICFGVILLQLGVTKVCQHNEVQLGNECCPPCGLGQRVTKVCTERTSVTCTPCPNGTYVSGLYNCTDCTQCNVTQVMIRNCTSTNNTVCAPKNHTYFSTPGVQHHKQRQQNHTAHITVKQGKSGRHTLAWLSLFIFLVGIILLILYLIAAYRSERCQQCCSIGKIFYRTL

SEQ ID NO: 132 - protein, 135 aa, Artificial Sequence
  Synthetic Construct
KVCQHNEVQLGNECCPPCGLGQRVTKVCTERTSVTCTPCPNGTYVSGLYNCTDCTQCNVTQVMIRNCTSTNNTVCAPKNHTYFSTPGVQHHKQRQQNHTAHITVKQGKSGRHTAAYRSERCQQCCSIGKIFYRTL

SEQ ID NO: 133 - protein, 338 aa, Human cytomegalovirus
  misc_feature: Strain Merlin
MCRRESLRTLPWLFWVLLSCPRLLEYSSSSFPFATADIAEKMWAENYETTSPAPVLVAEGEQVTIPCTVMTHSWPMVSIRARFCRSHDGSDELILDAVKGHRLMNGLQYRLPYATWNFSQLHLGQIFSLTFNVSTDTAGMYECVLRNYSHGLIMQRFVILTQLETLSRPDEPCCTPALGRYSLGDQIWSPTPWRLRNHDCGMYRGFQRNYFYIGRADAEDCWKPACPDEEPDRCWTVIQRYRLPGDCYRSQPHPPKFLPVTPAPPADIDTGMSPWATRGIAAFLGFWSIFTVCFLCYLCYLQCCGRWCPTPGRGRRGGEGYRRLPTYDSYPGVKKMKR

SEQ ID NO: 134 - protein, 281 aa, Artificial Sequence
  Synthetic Construct
DIAEKMWAENYETTSPAPVLVAEGEQVTIPCTVMTHSWPMVSIRARFCRSHDGSDELILDAVKGHRLMNGLQYRLPYATWNFSQLHLGQIFSLTFNVSTDTAGMYECVLRNYSHGLIMQRFVILTQLETLSRPDEPCCTPALGRYSLGDQIWSPTPWRLRNHDCGMYRGFQRNYFYIGRADAEDCWKPACPDEEPDRCWTVIQRYRLPGDCYRSQPHPPKFLPVTPAPPADIDTGMSPWATRYLQCCGRWCPTPGRGRRGGEGYRRLPTYDSYPGVKKMKR

SEQ ID NO: 135 - protein, 215 aa, Human cytomegalovirus
  misc_feature: Strain AD169
MNLVMLILALWAPVAGSMPELSLTLFDEPPPLVETEPLPPLSDVSEYRVEYSEARCVLRSGGRLEALWTLRGNLSVPTPTPRVYYQTLEGYADRVPTPVEDVSESLVAKRYWLRDYRVPQRTKLVLFYFSPCHQCQTYYVECEPRCLVPWVPLWSSLEDIERLLFEDRRLMAYYALTIKSAQYTLMMVAVIQVFWGLYVKGWLHRHFPWMFSDQW

SEQ ID NO: 136 - protein, 178 aa, Artificial Sequence
  Synthetic Construct
MPELSLTLFDEPPPLVETEPLPPLSDVSEYRVEYSEARCVLRSGGRLEALWTLRGNLSVPTPTPRVYYQTLEGYADRVPTPVEDVSESLVAKRYWLRDYRVPQRTKLVLFYFSPCHQCQTYYVECEPRCLVPWVPLWSSLEDIERLLFEDRRLMAYYALTIKSAQYHRHFPWMFSDQW

SEQ ID NO: 137 - protein, 742 aa, Human cytomegalovirus
MRPGLPSYLIVLAVCLLSHLLSPRYGAEAVSEPLDKAFHLLLNTYGRPIRFLRENATQCTYNSSLRNSTVVRENAISFNFFQSYNQYYVFHMPRCLFAGPLAEQFLNQVDLTETLERYQQRLNTYALVSKDLASYRSFSQQLKAQDSLGEQPTTVPPPIDLSIPHVWMPPQTTPHGWTESHTTSGLHRPHFNQTCILFDGHDLLFSTVTPCLHQGFYLIDELRYVKITLTEDFFVVTVSIDDDTPMLLIFGHLPRVLFKAPYQRDNFILRQTEKHELLVLVKKDQLNRHSYLKDPDFLDAALDFNYLDLSALLRNSFHRYAVDVLKSGRCQMLDRRTVEMAFAYALALFAAARQEEAGAQVSVPRALDRQAALLQIQEFMITCLSQTPPRTTLLLYPTAVDLAKRALWTPNQITDITSLVRLVYILSKQNQQHLIPQWALRQIADFALKLHKTHLASFLSAFARQELYLMGSLVHSMLVHTTERREIFIVETGLCSLAELSHFTQLLAHPHHEYLSDLYTPCSSSGRRDHSLERLTRLFPDATVPTTVPTALSILSTMQPSTLETFPDLFCLPLGESFSALTVSEHVSYVVTNQYLIKGISYPVSTTVVGQSLIITQTDSQSKCELTRNMHTTHSITAALNISLENCAFCQSALLEYDDTQGVINIMYMHDSDDVLFALDPYNEVVVSSPRTHYLMLLKNGTVLEVTDVVVDATDSRLLMMSVYALSAIIGIYLLYRMLKTC

SEQ ID NO: 138 - protein, 694 aa, Human cytomegalovirus
VSEPLDKAFHLLLNTYGRPIRFLRENATQCTYNSSLRNSTVVRENAISFNFFQSYNQYYVFHMPRCLFAGPLAEQFLNQVDLTETLERYQQRLNTYALVSKDLASYRSFSQQLKAQDSLGEQPTTVPPPIDLSIPHVWMPPQTTPHGWTESHTTSGLHRPHFNQTCILFDGHDLLFSTVTPCLHQGFYLIDELRYVKITLTEDFFVVTVSIDDDTPMLLIFGHLPRVLFKAPYQRDNFILRQTEKHELLVLVKKDQLNRHSYLKDPDFLDAALDFNYLDLSALLRNSFHRYAVDVLKSGRCQMLDRRTVEMAFAYALALFAAARQEEAGAQVSVPRALDRQAALLQIQEFMITCLSQTPPRTTLLLYPTAVDLAKRALWTPNQITDITSLVRLVYILSKQNQQHLIPQWALRQIADFALKLHKTHLASFLSAFARQELYLMGSLVHSMLVHTTERREIFIVETGLCSLAELSHFTQLLAHPHHEYLSDLYTPCSSSGRRDHSLERLTRLFPDATVPTTVPTALSILSTMQPSTLETFPDLFCLPLGESFSALTVSEHVSYVVTNQYLIKGISYPVSTTVVGQSLIITQTDSQSKCELTRNMHTTHSITAALNISLENCAFCQSALLEYDDTQGVINIMYMHDSDDVLFALDPYNEVVVSSPRTHYLMLLKNGTVLEVTDVVVDATDSRRMLKTC

SEQ ID NO: 139 - protein, 120 aa, Artificial Sequence
  Synthetic Construct
TYNSSLRNSTVVRENAISFNFFQSYNQYYVFHMPRGPGPGDLTETLERYQQRLNTYALVSKDLASYRSFSGPGPGSHTTSGLHRPHFNQTCILFDGPGPGQLNRHSYLKDPDFLDAALDF

SEQ ID NO: 140 - protein, 120 aa, Artificial Sequence
  Synthetic Construct
TYNSSLRNSTVVRENAISFNFFQSYNQYYVFHMPRPMGLPDLTETLERYQQRLNTYALVSKDLASYRSFSPMGLPSHTTSGLHRPHFNQTCILFDPMGLPQLNRHSYLKDPDFLDAALDF

SEQ ID NO: 141 - protein, 579 aa, Human cytomegalovirus
  misc_feature: Strain Towne
MESSAKRKMDPDNPDEGPSSKVPRPETPVTKATTFLQTMLRKEVNSQLSLGDPLFPELAEESLKTFERVTEDCNENPEKDVLAELGDILAQAVNHAGIDSSSTGPTLTTHSCSVSSAPLNKPTPTSVAVTNTPLPGASATPELSPRKKPRKTTRPFKVIIKPPVPPAPIMLPLIKQEDIKPEPDFTIQYRNKIIDTAGCIVISDSEEEQGEEVETRGATASSPSTGSGTPRVTSPTHPLSQMNHPPLPDPLGRPDEDSSSSSSSCSSASDSESESEEMKCSSGGGASVTSSHHGRGGFGGAASSSLLSCGHQSSGGASTGPRKKKSKRISELDNEKVRNIMKDKNTPFCTPNVQTRRGRVKIDEVSRMFRNTNRSLEYKNLPFTIPSMHQVLDEAIKACKTMQVNNKGIQIIYTRNHEVKSEVDAVRCRLGTMCNLALSTPFLMEHTMPVTHPPEVAQRTADACNEGVKAAWSLKELHTHQLCPRSSDYRNMIIHAATPVDLLGALNLCLPLMQKFPKQVMVRIFSTNQGGFMLPIYETAAKAYAVGQFEQPTETPPEDLDTLSLAIEAAIQDLRNKSQ

SEQ ID NO: 142 - protein, 60 aa, Artificial Sequence
  Synthetic Construct
RRGRVKIDEVSRMFRGPGPGGIQIIYTRNHEVKSEGPGPGLSTPFLMEHTMPVTHPPEVA

SEQ ID NO: 143 - protein, 60 aa, Artificial Sequence
  Synthetic Construct
RRGRVKIDEVSRMFRPMGLPGIQIIYTRNHEVKSEPMGLPLSTPFLMEHTMPVTHPPEVA

SEQ ID NO: 144 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 145 - protein, 965 aa, Homo sapiens
YQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 146 - protein, 1065 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVAITGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQENKLFAGIRRDGLLLRLVDDFLLVTPHLTHAKTFLRTLVRGVPEYGCVVNLRKTVVNFPVEDEALDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 147 - protein, 142 aa, Pongo abelii
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMD

SEQ ID NO: 148 - protein, 452 aa, Clostridium tetani
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 149 - protein, 111 aa, Artificial Sequence
  Synthetic Construct
PGINGKAIHLVNNESSEGPGPGFNNFTVSFWLRVPKVSASHLEQYGTGPGPGYVSIDKFRIFCKALNPKEIEKLYTSYLSGPGPGILRVGYNAPGIPLYKKMEAVKLRDLK

SEQ ID NO: 150 - protein, 111 aa, Artificial Sequence
  Synthetic Construct
PGINGKAIHLVNNESSEPMGLPFNNFTVSFWLRVPKVSASHLEQYGTPMGLPYVSIDKFRIFCKALNPKEIEKLYTSYLSPMGLPILRVGYNAPGIPLYKKMEAVKLRDLK

SEQ ID NO: 151 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 152 - protein, 1255 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIVSAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERAKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 153 - protein, 1196 aa, Artificial Sequence
  Synthetic Construct
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTLLQETELVEPLTPSGAMPNQAQMRILKETELRKVKVLGSGAFGTVYKGIWIPDGENVKIPVAIAVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERAKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 154 - protein, 610 aa, Artificial Sequence
  Synthetic Construct
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTH

SEQ ID NO: 155 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 156 - protein, 1295 aa, Artificial Sequence
  Synthetic Construct
SEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLESEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 157 - protein, 624 aa, Artificial Sequence
  Synthetic Construct
SEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLT

SEQ ID NO: 158 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 159 - protein, 164 aa, Artificial Sequence [sequence omitted]

SEQ ID NO: 160 - protein, 150 aa, Human papillomavirus type 16
MHQKRTAMFQDPQESGRKLPQLCTELQTTIHDIILECVYCKQQLLRREVYDRDLCIVYRDGNPYAVCDKCLKFYSKISEYRHYCYSLYGTTLEQQYNKPLCDLLIRCINCQKPLQRHLDKKQRFHNIRGRWTGRCMSCCRSSRTRRETQL

SEQ ID NO: 161 - protein, 150 aa, Human papillomavirus type 18
MARFEDPTRSGYKLPDLCTELNTSLQDIEITCVYCKTVLELTEVFEKDLFVVYRDSIPHAACHKCIDFYSRIRELRHYSDSVYGDTLEKLTNTGLYNLLIRCLRCQKPLLRHLNEKRRFHNIAGHYRGQCHSCCNRARQERLQRRRETQV

SEQ ID NO: 162 - protein, 98 aa, Human papillomavirus type 16
MHGDTPTLHEYMLDLQPETTDLYGYGQLNDSSEEEDEIDGPAGQAEPDRAHYNIVTFCCKCDSTLRLCVQSTHVDIRTLEDLLMGTLGIVCPICSQKP

SEQ ID NO: 163 - protein, 105 aa, Human papillomavirus type 18
MHGPKATLQDIVLHLEPQNEIPVDLLGHGQLSDSEEENDEIDGVNHQHLPARRAEPQRHTMLCMCCKCEARIELVVESSADDLRAFQQLFLNTLSFVCPWCASQQ

SEQ ID NO: 164 - protein, 253 aa, Artificial Sequence
  Synthetic Construct
MHQKRTAMFQDPQESGRKLPQLCTELQTTIHDIILECVYCKQQLLRREVYDRDLCIVYRDGNPYAVCDKCLKFYSKISEYRHYCYSLYGTTLEQQYNKPLCDLLIRCINCQKPLQRHLDKKQRFHNIRGRWTGRCMSCCRSSRTRRETQLGPGPGMHGDTPTLHEYMLDLQPETTDLYGYGQLNDSSEEEDEIDGPAGQAEPDRAHYNIVTFCCKCDSTLRLCVQSTHVDIRTLEDLLMGTLGIVCPICSQKP

SEQ ID NO: 165 - protein, 260 aa, Artificial Sequence
  Synthetic Construct
MARFEDPTRSGYKLPDLCTELNTSLQDIEITCVYCKTVLELTEVFEKDLFVVYRDSIPHAACHKCIDFYSRIRELRHYSDSVYGDTLEKLTNTGLYNLLIRCLRCQKPLLRHLNEKRRFHNIAGHYRGQCHSCCNRARQERLQRRRETQVGPGPGMHGPKATLQDIVLHLEPQNEIPVDLLGHGQLSDSEEENDEIDGVNHQHLPARRAEPQRHTMLCMCCKCEARIELVVESSADDLRAFQQLFLNTLSFVCPWCASQQ

SEQ ID NO: 166 - protein, 518 aa, Artificial Sequence
  Synthetic Construct
MHQKRTAMFQDPQESGRKLPQLCTELQTTIHDIILECVYCKQQLLRREVYDRDLCIVYRDGNPYAVCDKCLKFYSKISEYRHYCYSLYGTTLEQQYNKPLCDLLIRCINCQKPLQRHLDKKQRFHNIRGRWTGRCMSCCRSSRTRRETQLGPGPGMARFEDPTRSGYKLPDLCTELNTSLQDIEITCVYCKTVLELTEVFEKDLFVVYRDSIPHAACHKCIDFYSRIRELRHYSDSVYGDTLEKLTNTGLYNLLIRCLRCQKPLLRHLNEKRRFHNIAGHYRGQCHSCCNRARQERLQRRRETQVGPGPGMHGDTPTLHEYMLDLQPETTDLYGYGQLNDSSEEEDEIDGPAGQAEPDRAHYNIVTFCCKCDSTLRLCVQSTHVDIRTLEDLLMGTLGIVCPICSQKPGPGPGMHGPKATLQDIVLHLEPQNEIPVDLLGHGQLSDSEEENDEIDGVNHQHLPARRAEPQRHTMLCMCCKCEARIELVVESSADDLRAFQQLFLNTLSFVCPWCASQQ

SEQ ID NO: 167 - protein, 158 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQQRR

SEQ ID NO: 168 - protein, 79 aa, Homo sapiens
ARGPESRLLEFYLAMPFATPMEAELARRSLAQDAPPLPVPGVLLKEFTVSGNILTIRLTAADHRQLQLSISSCLQQQRR

SEQ ID NO: 169 - protein, 641 aa, Human gammaherpesvirus 4
MSDEGPGTGPGNGLGEKGDTSGPEGSGGSGPQRRGGDNHGRGRGRGRGRGGGRPGAPGGSGSGPRHRDGVRRPQKRPSCIGCKGTHGGTGAGAGAGGAGAGGAGAGGGAGAGGGAGGAGGAGGAGAGGGAGAGGGAGGAGGAGAGGGAGAGGGAGGAGAGGGAGGAGGAGAGGGAGAGGGAGGAGAGGGAGGAGGAGAGGGAGAGGAGGAGGAGAGGAGAGGGAGGAGGAGAGGAGAGGAGAGGAGAGGAGGAGAGGAGGAGAGGAGGAGAGGGAGGAGAGGGAGGAGAGGAGGAGAGGAGGAGAGGAGGAGAGGGAGAGGAGAGGGGRGRGGSGGRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 170 - protein, 391 aa, Human gammaherpesvirus 4
MSDEGPGTGPGNGLGEKGDTSGPEGSGGSGPQRRGGDNHGRGRGRGRGRGGGRPGAPGGSGSGPRHRDGVRRPQKRPSCIGCKGTHRGRGGSGGRGRGGSGGRRGRGRERARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEGQE

SEQ ID NO: 171 - protein, 860 aa, Human gammaherpesvirus 4
MEAALLVCQYTIQSLIHLTGEDPGFFNVEIPEFPFYPTCNVCTADVNVTINFDVGGKKHQLDLDFGQLTPHTKAVYQPRGAFGGSENATNLFLLELLGAGELALTMRSKKLPINVTTGEEQQVSLESVDVYFQDVFGTMWCHHAEMQNPVYLIPETVPYIKWDNCNSTNITAVVRAQGLDVTLPLSLPTSAQDSNFSVKTEMLGNEIDIECIMEDGEISQVLPGDNKFNITCSGYESHVPSGGILTSTSPVATPIPGTGYAYSLRLTPRPVSRFLGNNSILYVFYSGNGPKASGGDYCIQSNIVFSDEIPASQDMPTNTTDITYVGDNATYSVPMVTSEDANSPNVTVTAFWAWPNNTETDFKCKWTLTSGTPSGCENISGAFASNRTFDITVSGLGTAPKTLIITRTATNATTTTHKVIFSKAPESTTTSPTLNTTGFADPNTTTGLPSSTHVPTNLTAPASTGPTVSTADVTSPTPAGTTSGASPVTPSPSPWDNGTESKAPDMTSSTSPVTTPTPNATSPTPAVTTPTPNATSPTPAVTTPTPNATSPTLGKTSPTSAVTTPTPNATSPTLGKTSPTSAVTTPTPNATSPTLGKTSPTSAVTTPTPNATGPTVGETSPQANATNHTLGGTSPTPVVTSQPKNATSAVTTGQHNITSSSTSSMSLRPSSNPETLSPSTSDNSTSHMPLLTSAHPTGGENITQVTPASISTHHVSTSSPAPRPGTTSQASGPGNSSTSTKPGEVNVTKGTPPQNATSPQAPSGQKTAVPTVTSTGGKANSTTGGKHTTGHGARTSTEPTTDYGGDSTTPRPRYNATTYLPPSTSSKLRPRWTFTSPPVTTAQATVPVPPTSQPRFSNLS

SEQ ID NO: 172 - protein, 497 aa, Human gammaherpesvirus 4
MGSLEMVPMGAGPPSPGGDPDGYDGGNNSQYPSASGSSGNTPTPPNDEERESNEEPPPPYEDPYWGNGDRHSDYQPLGTQDQSLYLGLQHDGNDGLPPPPYSPRDDSSQHIYEEAGRGSMNPVCLPVIVAPYLFWLAAIAASCFTASVSTVVTATGLALSLLLLAAVASSYAAAQRKLLTPVTVLTAVVTFFAICLTWRIEDPPFNSLLFALLAAAGGLQGIYVLVMLVLLILAYRRRWRRLTVCGGIMFLACVLVLIVDAVLQLSPLLGAVTVVSMTLLLLAFVLWLSSPGGLGTLGAALLTLAAALALLASLILGTLNLTTMFLLMLLWTLVVLLICSSCSSCPLSKILLARLFLYALALLLLASALIAGGSILQTNFKSLSSTEFIPNLFCMLLLIVAGILFILAILTEWGSGNRTYGPVFMCLGGLLTMVAGAVWLTVMSNTLLSAWILTAGFLIFLIGFALFGVIRCCRYCCYYCLTLESEERPPTPYRNTV

SEQ ID NO: 173 - protein, 540 aa, Homo sapiens
AQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLK

SEQ ID NO: 174 - protein, 192 aa, Hepatitis B virus
  SITE (192)..(192): Xaa can be any naturally occurring amino acid
MQWNSTTFHQTLQDPRVRGLYFPAGGSSSGTVNPVLTTASPLSSIFSRIGDPALNMENITSGTIPQSLDSWWTSLNFLGGTTVCLGQNSQSPTSNHSPTSCPPTCPGYRWMCLRRDYQGMLPVCPLIPGSSTTSTGPCRTCMTTAQGTSMYPSCCCTKPSDGNCTCIPIPSSWAFGKFLWEWASARYWGPSX

SEQ ID NO: 175 - protein, 120 aa, Hepatitis B virus
MAARLCCQLDPARDVLCLRPVGAESRGRPLSGPLGALPSPSPSAVPADHGAHLSLRGLPVCAFSSAGPCALRFTSARRMETTVNAHQILPKVLHKRTFGLSAMSTTDLEAYFKDCVFKDW

SEQ ID NO: 176 - protein, 120 aa, Homo sapiens
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 177 - protein, 289 aa, Homo sapiens [sequence omitted]

SEQ ID NO: 178 - protein, 719 aa, Homo sapiens
QDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLYCTRCGPHAPNKRITDCYRWVIHAGSKSPTEPMPPRGSLTGVQTCRTSV

SEQ ID NO: 179 - protein, 653 aa, Artificial Sequence
  Synthetic Construct
TQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIVSAVVGILLVVVLGVVFGILI

SEQ ID NO: 180 - protein, 651 aa, Homo sapiens
KLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNKLSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSA

SEQ ID NO: 181 - protein, 76 aa, Homo sapiens
MKTNDTYMKFSWLTVPEKSLDKEHRCIVRHENNKNGVDQEIIFPPIKTDVITMDPKDNCSKDANDTLLLQLTNTSA

SEQ ID NO: 182 - protein, 324 aa, Homo sapiens
MVQRLWVSRLLRHRKAQLPPLLLEVGVEEKSASDHWRGRYGRRRPLAGLLCPDPRPTPLEALLSDLFRDPDHCRQADWDTSALAPYLGTQEECEEAALGPTEPAEGLSAPSLSPHCCPCRARLAFRNLGALLPRLHQLCCRMPRTLRRLVGEGLYQGVPRAEPGTEARRHYDEGVRRLVQRFGTRASVAVVTASYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTFDKSDLAKYSA

SEQ ID NO: 183 - protein, 729 aa, Homo sapiens
MWNLLHETDSAVATARRPRWLCKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 184 - protein, 165 aa, Homo sapiens
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAKKVRRAIEQLAAMD

SEQ ID NO: 185 - protein, 1137 aa, Homo sapiens
TGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPG

SEQ ID NO: 186 - protein, 252 aa, Homo sapiens
TGSGHASSTPGGEKETSATQRSSVPSSTEKNALSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 187 - protein, 241 aa, Homo sapiens
MKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 188 - protein, 449 aa, Homo sapiens
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 189 - protein, 322 aa, Homo sapiens
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRP

SEQ ID NO: 190 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 191 - protein, 210 aa, Homo sapiens
MQAEGQGTGGSTGDADGPGGPGIPDGPGGNAGGPGEAGATGGRGPRGAGAARASGPRGGAPRGPHGGAASAQDGRCPCGARRPDSRLLQLHITMPFSSPMEAELVRRILSRDAAPLPRPGAVLKDFTVSGNLLFMSVRDQDREGAGRMRVVGWGLGSASPEGQKARDLRTPKHKVSEQRPGTPGPPPPEGAQGDGCRGVAFNVMFSAPHI

SEQ ID NO: 192 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 193 - protein, 562 aa, Artificial Sequence
  Synthetic Construct
MAPRSARRPLLLLLLLLLLGLMHCASAAMFMVKNGNGTACIMANFSAAFSVNYDTKSGPKNMTLDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSLEMGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMDEFTLIPIAVGGALAGLVLIVLIAYLVGRKRSHAGYQTI

SEQ ID NO: 194 - protein, 558 aa, Artificial Sequence
  Synthetic Construct
MAPRSARRPLLLLLLLLLLGLMHCASAMGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMDAMFMVKNGNGTACIMANFSAAFSVNYDTKSGPKNMTLDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 195 - protein, 370 aa, Artificial Sequence
  Synthetic Construct
MAPRSARRPLLLLLLLLLLGLMHCASAMGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMDAMFMVKNGNGTACIMANFSAAFSVNYDTKSGPKNMTLDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDLIPIAVGGALAGLVLIVLIAYLVGRKRSHAGYQTI

SEQ ID NO: 196 - protein, 375 aa, Artificial Sequence
  Synthetic Construct
MAPRSARRPLLLLLLLLLLGLMHCASAAMFMVKNGNGTACIMANFSAAFSVNYDTKSGPKNMTLDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDLEMGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMDEFTLIPIAVGGALAGLVLIVLIAYLVGRKRSHAGYQTI

SEQ ID NO: 197 - protein, 527 aa, Artificial Sequence
  Synthetic Construct
MAPRSARRPLLLLLLLLLLGLMHCASAAMFMVKNGNGTACIMANFSAAFSVNYDTKSGPKNMTLDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDLEMGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAKKVRRAIEQLAAMDEFTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 198 - protein, 365 aa, Artificial Sequence
  1A01_HLA-A/m__Homo_sapiens__P30443
MAVMAPRTLLLLLSGALALTQTWAGSHSMRYFFTSVSRPGRGEPRFIAVGYVDDTQFVRFDSDAASQKMEPRAPWIEQEGPEYWDQETRNMKAHSQTDRANLGTLRGYYNQSEDGSHTIQIMYGCDVGPDGRFLRGYRQDAYDGKDYIALNEDLRSWTAADMAAQITKRKWEAVHAAEQRRVYLEGRCVDGLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 199 - protein, 365 aa, Artificial Sequence [sequence omitted]

SEQ ID NO: 200 - protein, 420 aa, Artificial Sequence
  5T4__Homo_sapiens__Q13641
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 201 - protein, 543 aa, Artificial Sequence
  ACRBP__Homo_sapiens__Q8NEB7
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGGQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEALLVLCYSIVENTCIITPTAKAWKYMEEEILGFGKSVCDSLGRRHMSTCALCDFCSLKLEQCHSEASLQRQQCDTSHKTPFVSPLLASQSLSIGNQVGSPESGRFYGLDLYGGLHMDFWCARLATKGCEDVRVSGWLQTEFLSFQDGDFPTKICDTDYIQYPNYCSFKSQQCLMRNRNRKVSRMRCLQNETYSALSPGKSEDVVLRWSQEFSTLTLGQFG

SEQ ID NO: 202 - protein, 609 aa, Artificial Sequence
  AFP__Homo_sapiens__P02771
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 203 - protein, 854 aa, Artificial Sequence
  AKAP4__Homo_sapiens__Q5JQC9
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 204 - protein, 416 aa, Artificial Sequence
  alpha-actinin-_4/m__Homo_sapiens__B4DSX0
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSWRSRASSSPTSTCAASSPARPMLWGPGSRPRWRRSGASPLR

SEQ ID NO: 205 - protein, 562 aa, Artificial Sequence [sequence omitted]

SEQ ID NO: 206 - protein, 911 aa, Artificial Sequence
  alpha-actinin-_4/m__Homo_sapiens__O43707
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 207 - protein, 198 aa, Artificial Sequence [sequence omitted]

SEQ ID NO: 208 - protein, 198 aa, Artificial Sequence [sequence omitted]

SEQ ID NO: 209 - protein, 920 aa, Artificial Sequence
  ANDR__Homo_sapiens__P10275
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 210 - protein, 412 aa, Artificial Sequence [sequence omitted]

SEQ ID NO: 211 - protein, 327 aa, Artificial Sequence
  ARTC1/m__Homo_sapiens__P52961
MQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRLAQGPARIYLRALGKHSTYNCEYIKDKKCKSGPCHLDNSAMGQSPLSAVWSLLLLLWFLVVRAFPDGPGLL

SEQ ID NO: 212 - protein, 344 aa, Artificial Sequence
  AURKB__Homo_sapiens__Q96GD4
MAQKENSYPWPYGRQTAPSGLSTLPQRVLRKEPVTPSALVLMSRSNVQPTAAPGQKVMENSSGTPDILTRHFTIDDFEIGRPLGKGKFGNVYLAREKKSHFIVALKVLFKSQIEKEGVEHQLRREIEIQAHLHHPNILRLYNYFYDRRRIYLILEYAPRGELYKELQKSCTFDEQRTATIMEELADALMYCHGKKVIHRDIKPENLLLGLKGELKIADFGWSVHAPSLRRKTMCGTLDYLPPEMIEGRMHNEKVDLWCIGVLCYELLVGNPPFESASHNETYRRIVKVDLKFPASVPMGAQDLISKLLRHNPSERLPLAQVSAHPWVRANSRRVLPPSALQSVA

SEQ ID NO: 213 - protein, 119 aa, Artificial Sequence
  B2MG__Homo_sapiens__P61769
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 214 - protein, 378 aa, Artificial Sequence
  B3GN5__Homo_sapiens__Q9BYG0
MRMLVSGRRVKKWQLIIQLFATCFLASLMFFWEPIDNHIVSHMKSYSYRYLINSYDFVNDTLSLKHTSAGPRYQYLINHKEKCQAQDVLLLLFVKTAPENYDRRSGIRRTWGNENYVRSQLNANIKTLFALGTPNPLEGEELQRKLAWEDQRYNDIIQQDFVDSFYNLTLKLLMQFSWANTYCPHAKFLMTADDDIFIHMPNLIEYLQSLEQIGVQDFWIGRVHRGAPPIRDKSSKYYVSYEMYQWPAYPDYTAGAAYVISGDVAAKVYEASQTLNSSLYIDDVFMGLCANKIGIVPQDHVFFSGEGKTPYHPCIYEKMMTSHGHLEDLQDLWKNATDPKVKTISKGFFGQIYCRLMKIILLCKISYVDTYPCRAAFI

SEQ ID NO: 215 - protein, 533 aa, Artificial Sequence
  B4GN1__Homo_sapiens__Q00973
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 216 - protein, 282 aa, Artificial Sequence
  B7H4__Homo_sapiens__Q7Z7D3
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 217 - protein, 43 aa, Artificial Sequence
  BAGE-1__Homo_sapiens__Q13072
MAARAVFLALSAQLLQARLMKEESPVVSWRLEPEDGTALCFIF

SEQ ID NO: 218 - protein, 385 aa, Artificial Sequence
  BASI__Homo_sapiens__P35613
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 219 - protein, 239 aa, Artificial Sequence [sequence omitted]

SEQ ID NO: 220 - protein, 429 aa, Artificial Sequence [sequence omitted]

SEQ ID NO: 221 - protein, 554 aa, Artificial Sequence [sequence omitted]

SEQ ID NO: 222 - protein, 514 aa, Artificial Sequence [sequence omitted]

SEQ ID NO: 223 - protein, 441 aa, Artificial Sequence
  bcr/abl__Homo_sapiens__A9UEZ9
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSLELQGKPSRWTQ

SEQ ID NO: 224 - protein, 524 aa, Artificial Sequence
  bcr/abl__Homo_sapiens__A9UF00
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWDPVKMTPTFSLHCMILWPVEITL

SEQ ID NO: 225 - protein, 465 aa, Artificial Sequence
  bcr/abl__Homo_sapiens__A9UF01
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGEHPGAAEEVFQKLLPDIRGAADADQLVCETPDCPQHSADHQ

SEQ ID NO: 226 - protein, 458 aa, Artificial Sequence
  bcr/abl__Homo_sapiens__A9UF03
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYCCLCLPAWPSGCTAATARVTRS

SEQ ID NO: 227 - protein, 454 aa, Artificial Sequence
  bcr/abl__Homo_sapiens__A9UF04
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAAGRPPHLTELPVQHQ

SEQ ID NO: 228 - protein, 467 aa, Artificial Sequence
  bcr/abl__Homo_sapiens__A9UF05
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDAVLKTEVPHQGVRRARLSLEALGEDPSFLFPASDGPRHSSTW

SEQ ID NO: 229 - protein, 513 aa, Artificial Sequence
  bcr/abl__Homo_sapiens__A9UF06
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDPVKMTPTFSLHCMILWPVEITL

SEQ ID NO: 230 - protein, 406 aa, Artificial Sequence [sequence omitted]

SEQ ID NO: 231 - protein, 781 aa, Artificial Sequence
  beta-catenin/m__Homo_sapiens__P35222
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 232 - protein, 563 aa, Artificial Sequence
  beta-catenin/m__Homo_sapiens__Q8WYA6
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPFDANKLYCSEVLAILLQDNDENRELLGELDGIDVLLQQLSVFKRHNPSTAEEQEMMENLFDSLCSCLMLSSNRERFLKGEGLQLMNLMLREKKISRSSALKVLDHAMIGPEGTDNCHKFVDILGLRTIFPLFMKSPRKIKKVGTTEKEHEEHVCSILASLLRNLRGQQRTRLLNKFTENDSEKVDRLMELHFKYLGAMQVADKKIEGEKHDMVRRGEIIDNDTEEEFYLRRLDAGLFVLQHICYIMAEICNANVPQIRQRVHQILNMRGSSIKIVRHIIKEYAENIGDGRSPEFRENEQKRILGLLENF

SEQ ID NO: 233 - protein, 610 aa, Artificial Sequence
  BING-4__Homo_sapiens__O15213
METAPKPGKDVPPKKDKLQTKRKKPRRYWEEETVPTTAGASPGPPRNKKNRELRPQRPKNAYILKKSRISKKPQVPKKPREWKNPESQRGLSGTQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 234 - protein, 298 aa, Artificial Sequence
  BIRC7__Homo_sapiens__Q96CA5
MGPKDSAKCLHRGPQPSHWAAGDGPTQERCGPRSLGSPVLGLDTCRAWDHVDGQILGQLRPLTEEEEEEGAGATLSRGPAFPGMGSEELRLASFYDWPLTAEVPPELLAAAGFFHTGHQDKVRCFFCYGGLQSWKRGDDPWTEHAKWFPSCQFLLRSKGRDFVHSVQETHSQLLGSWDPWEEPEDAAPVAPSVPASGYPELPTPRREVQSESAQEPGGVSPAEAQRAWWVLEPPGARDVEAQLRRLQEERTCKVCLDRAVSIVFVPCGHLVCAECAPGLQLCPICRAPVRSRVRTFLS

SEQ ID NO: 235 - protein, 759 aa, Artificial Sequence
  BRCA1/m__Homo_sapiens__A0A024R1V0
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 236 - protein, 719 aa, Artificial Sequence
  BRCA1/m__Homo_sapiens__A0A024R1V7
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 237 - protein, 721 aa, Artificial Sequence
  BRCA1/m__Homo_sapiens__A0A024R1Z8
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 238 - protein, 11 aa, Artificial Sequence
  BRCA1/m__Homo_sapiens__A0A068BFX7
MDLSALRVEEV

SEQ ID NO: 239 - protein, 173 aa, Artificial Sequence
  BRCA1/m__Homo_sapiens__C6YB45
MDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 240 - protein, 354 aa, Artificial Sequence [sequence omitted]

SEQ ID NO: 241 - protein, 680 aa, Artificial Sequence
  BRCA1/m__Homo_sapiens__G3XAC3
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 242 - protein, 181 aa, Artificial Sequence
  BY55__Homo_sapiens__O95971
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 243 - protein, 109 aa, Artificial Sequence [sequence omitted]

SEQ ID NO: 244 - protein, 522 aa, Artificial Sequence
  CASPA__Homo_sapiens__Q92851-4
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 245 - protein, 339 aa, Artificial Sequence
  cathepsin_B__Homo_sapiens__A0A024R374
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDGCNGGYPAEAWNFWTRKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSDFLLYKSGVYQHVTGEMMGGHAIRILGWGVENGTPYWLVANSWNTDWGDNGFFKILRGQDHCGIESEVVAGIPRTDQYWEKI

SEQ ID NO: 246 - protein, 339 aa, Artificial Sequence; identical to SEQ ID NO: 245
  cathepsin_B__Homo_sapiens__P07858

SEQ ID NO: 247 - protein, 333 aa, Artificial Sequence [sequence omitted]

SEQ ID NO: 248 - protein, 333 aa, Artificial Sequence [sequence omitted]

SEQ ID NO: 249 - protein, 151 aa, Artificial Sequence
  cathepsin_L__Homo_sapiens__Q9HBQ7
MDYAFQYVQDNGGLDSEESYPYEATEESCKYNPKYSVANDTGFVDIPKQEKALMKAVATVGPISVAIDAGHESFLFYKEGIYFEPDCSSEDMDHGVLVVGYGFESTESDNNKYWLVKNSWGEEWGMGGYVKMAKDRRNHCGIASAASYPTV

SEQ ID NO: 250 - protein, 327 aa, Artificial Sequence
  CD1A__Homo_sapiens__P06126
MLFLLLPLLAVLPGDGNADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 251 - protein, 333 aa, Artificial Sequence
  CD1B__Homo_sapiens__P29016
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 252 - protein, 333 aa, Artificial Sequence
  CD1C__Homo_sapiens__P29017
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 253 - protein, 335 aa, Artificial Sequence
  CD1D__Homo_sapiens__P15813
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 254 - protein, 388 aa, Artificial Sequence
  CD1E__Homo_sapiens__P15812
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 255 - protein, 297 aa, Artificial Sequence
  CD20__Homo_sapiens__P11836
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 256 - protein, 662 aa, Artificial Sequence [sequence omitted]

SEQ ID NO: 257 - protein, 847 aa, Artificial Sequence
  CD22__Homo_sapiens__P20273
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 258 - protein, 847 aa, Artificial Sequence; identical to SEQ ID NO: 257
  CD22__Homo_sapiens__Q0EAF5

SEQ ID NO: 259 - protein, 534 aa, Artificial Sequence
  CD276__Homo_sapiens__Q5ZPR3
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 260 - protein, 212 aa, Artificial Sequence
  CD33__Homo_sapiens__B4DF51
MPLLLLLPLLWADLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPVSDGASWHPVCPADTSSQCGPPSCPIQHFQN

SEQ ID NO: 261 - protein, 364 aa, Artificial Sequence
  CD33__Homo_sapiens__P20138
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 262 - protein, 364 aa, Artificial Sequence; identical to SEQ ID NO: 261
  CD33__Homo_sapiens__Q546G0

SEQ ID NO: 263 - protein, 207 aa, Artificial Sequence
  CD3E__Homo_sapiens__P07766
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 264 - protein, 164 aa, Artificial Sequence
  CD3Z__Homo_sapiens__P20963
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 265 - protein, 742 aa, Artificial Sequence
  CD44_Isoform_1__Homo_sapiens__P16070
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 266 - protein, 699 aa, Artificial Sequence
  CD44_Isoform_6__Homo_sapiens__P16070-6
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 267 - protein, 458 aa, Artificial Sequence
  CD4__Homo_sapiens__P01730
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 268 - protein, 61 aa, Artificial Sequence
  CD52__Homo_sapiens__P31358
MKRFLFLLLTISLLVMVQIQTGLSGQNDTSQTSSPSASSNISGGIFLFFVANAIIHLFCFS

SEQ ID NO: 269 - protein, 61 aa, Artificial Sequence
  CD52__Homo_sapiens__Q6IBD0
MKRFLFLLLTISLLVMVQIQTGLSGQNDTSQTSSPSASSSMSGGIFLFFVANAIIHLFCFS

SEQ ID NO: 270 - protein, 61 aa, Artificial Sequence; identical to SEQ ID NO: 268
  CD52__Homo_sapiens__V9HWN9

SEQ ID NO: 271 - protein, 317 aa, Artificial Sequence
  CD55__Homo_sapiens__B1AP15
MTVARPSVPAALPLLGELPRLLLLVLLCLPAVWGDCGLPPDVPNAQPALEGRTSFPEDTVITYKCEESFVKIPGEKDSVICLKGSQWSDIEEFCNQKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 272 - protein, 293 aa, Artificial Sequence [sequence omitted]

SEQ ID NO: 273 - protein, 267 aa, Artificial Sequence [sequence omitted]

SEQ ID NO: 274 - protein, 381 aa, Artificial Sequence
  CD55__Homo_sapiens__P08174
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 275 - protein, 858 aa, Artificial Sequence
  CD56__Homo_sapiens__P13591
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 276 - protein, 288 aa, Artificial Sequence
  CD80__Homo_sapiens__A0N0P2
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 277 - protein, 288 aa, Artificial Sequence; identical to SEQ ID NO: 276
  CD80__Homo_sapiens__P33681

SEQ ID NO: 278 - protein, 329 aa, Artificial Sequence
  CD86__Homo_sapiens__P42081
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 279 - protein, 235 aa, Artificial Sequence
  CD8A__Homo_sapiens__P01732
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 280 - protein, 823 aa, Artificial Sequence
  CDC27/m__Homo_sapiens__G5EA36
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 281 - protein, 824 aa, Artificial Sequence
  CDC27/m__Homo_sapiens__P30260
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 282 - protein, 595 aa, Artificial Sequence
  CDE30__Homo_sapiens__P28908
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 283 - protein, 303 aa, Artificial Sequence
  CDK4/m__Homo_sapiens__A0A024RBB6
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 284 - protein, 303 aa, Artificial Sequence; identical to SEQ ID NO: 283
  CDK4/m__Homo_sapiens__P11802

SEQ ID NO: 285 - protein, 229 aa, Artificial Sequence
  CDK4/m__Homo_sapiens__Q6LC83
MDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 286 - protein, 111 aa, Artificial Sequence
  CDK4/m__Homo_sapiens__Q96BE9
MATSRYEPVAEIGVGAYGTVYKARDPHSGHFVALKSVRVPNGGGGGGGLPISTVREVALLRRLEAFEHPNVVRLMDVCATSRTDREIKRCFVESLSSVETLKPTSWAKSLT

SEQ ID NO: 287 - protein, 142 aa, Artificial Sequence [sequence omitted]

SEQ ID NO: 288 - protein, 116 aa, Artificial Sequence
  CDKN2A/m__Homo_sapiens__G3XAG3
MEPAAGSSMEPSADWLATAAARGRVEEVRALLEAGALPNAPNSYGRRPIQVGRGSAAGAGDGGRLWRTKFAGELESGSASILRKKGRLPGEFSEGVCNHRPPPGDALGAWEAKEEE

SEQ ID NO: 289 - protein, 156 aa, Artificial Sequence
  CDKN2A/m__Homo_sapiens__K7PML8
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 290 - protein, 108 aa, Artificial Sequence
  CDKN2A/m__Homo_sapiens__L8E941
MEVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 291 - protein, 132 aa, Artificial Sequence
  CDKN2A/m__Homo_sapiens__Q8N726
MVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 292 - protein, 702 aa, Artificial Sequence
  CEA__Homo_sapiens__NP_004354
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 293 - protein, 344 aa, Artificial Sequence
  CEAM6__Homo_sapiens__P40199
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 294 - protein, 390 aa, Artificial Sequence
  CH3L2__Homo_sapiens__Q15782
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYLFGSKGFHPMVDSSTSRLEFINSIILFLRNHNFDGLDVSWIYPDQKENTHFTVLIHELAEAFQKDFTKSTKERLLLTAGVSAGRQMIDNSYQVEKLAKDLDFINLLSFDFHGSWEKPLITGHNSPLSKGWQDRGPSSYYNVEYAVGYWIHKGMPSEKVVMGIPTYGHSFTLASAETTVGAPASGPGAAGPITESSGFLAYYEICQFLKGAKITRLQDQQVPYAVKGNQWVGYDDVKSMETKVQFLKNLNLGGAMIWSIDMDDFTGKSCNQGPYPLVQAVKRSLGSL

SEQ ID NO: 295 - protein, 943 aa, Artificial Sequence
  CLCA2__Homo_sapiens__Q9UQC9
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 296 - protein, 235 aa, Artificial Sequence
  CML28__Homo_sapiens__Q9NQT4
MEEETHTDAKIRAENGTGSSPRGPGCSLRHFACEQNLLSRPDGSASFLQGDTSVLAGVYGPAEVKVSKEIFNKATLEVILRPKIGLPGVAEKSRERLIRNTCEAVVLGTLHPRTSITVVLQVVSDAGSLLACCLNAACMALVDAGVPMRALFCGVACALDSDGTLVLDPTSKQEKEARAVLTFALDSVERKLLMSSTKGLYSDTELQQCLAAAQAASQHVFRFYRESLQRRYSKS

SEQ ID NO: 297 - protein, 583 aa, Artificial Sequence
  CML66__Homo_sapiens__Q96RS6
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSLTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 298 - protein, 520 aa, Artificial Sequence
  COA-1/m__Homo_sapiens__Q5T124
MSSPLASLSKTRKVPLPSEPMNPGRRGIRIYGDEDEVDMLSDGCGSEEKISVPSCYGGIGAPVSRQVPASHDSELMAFMTRKLWDLEQQVKAQTDEILSKDQKIAALEDLVQTLRPHPAEATLQRQEELETMCVQLQRQVREMERFLSDYGLQWVGEPMDQEDSESKTVSEHGERDWMTAKKFWKPGDSLAPPEVDFDRLLASLQDLSELVVEGDTQVTPVPGGARLRTLEPIPLKLYRNGIMMFDGPFQPFYDPSTQRCLRDILDGFFPSELQRLYPNGVPFKVSDLRNQVYLEDGLDPFPGEGRVVGRQLMHKALDRVEEHPGSRMTAEKFLNRLPKFVIRQGEVIDIRGPIRDTLQNCCPLPARIQEIVVETPTLAAERERSQESPNTPAPPLSMLRIKSENGEQAFLLMMQPDNTIGDVRALLAQARVMDASAFEIFSTFPPTLYQDDTLTLQAAGLVPKAALLLRARRAPKSSLKFSPGPCPGPGPGPSPGPGPGPSPGPGPGPSPCPGPSPSPQ

SEQ ID NO: 299 - protein, 142 aa, Artificial Sequence
  coactosin-like_protein__Homo_sapiens__Q14019
MATKIDKEACRAAYNLVRDDGSAVIWVTFKYDGSTIVPGEQGAEYQHFIQQCTDDVRLFAFVRFTTGDAMSKRSKFALITWIGENVSGLQRAKTGTDKTLVKEVVQNFAKEFVISDRKELEEDFIKSELKKAGGANYDAQTE

SEQ ID NO: 300 - protein, 164 aa, Artificial Sequence
  collagen_XXIII__Homo_sapiens__L8EAS4
MATRDPWVWMASPDFQARKGKRVHQETLAPGETKDKMELLGLRGPLDLLGPGALLATLGKMAPGEHKAQRAPKESPDKTARWAQRDPQGPRVSLEYLERRATMGHQASLDHQGPRASQGAWGLGERTVWTVPQDRRGSLATEARMELQGPGVPQASRASRETQW

SEQ ID NO: 301 - protein, 540 aa, Artificial Sequence
  collagen_XXIII__Homo_sapiens__Q86Y22
MGPGERAGGGGDAGKGNAAGGGGGGRSATTAGSRAVSALCLLLSVGSAAACLLLGVQAAALQGRVAALEEERELLRRAGPPGALDAWAEPHLERLLREKLDGLAKIRTAREAPSECVCPPGPPGRRGKPGRRGDPGPPGQSGRDGYPGPLGLDGKPGLPGPKGEKGAPGDFGPRGDQGQDGAAGPPGPPGPPGARGPPGDTGKDGPRGAQGPAGPKGEPGQDGEMGPKGPPGPKGEPGVPGKKGDDGTPSQPGPPGPKGEPGSMGPRGENGVDGAPGPKGEPGHRGTDGAAGPRGAPGLKGEQGDTVVIDYDGRILDALKGPPGPQGPPGPPGIPGAKGELGLPGAPGIDGEKGPKGQKGDPGEPGPAGLKGEAGEMGLSGLPGADGLKGEKGESASDSLQESLAQLIVEPGPPGPPGPPGPMGLQGIQGPKGLDGAKGEKGASGERGPSGLPGPVGPPGLIGLPGTKGEKGRPGEPGLDGFPGPRGEKGDRSERGEKGERGVPGRKGVKGQKGEPGPPGLDQPCPVGPDGLPVPGCWHK

SEQ ID NO: 302 - protein, 163 aa, Artificial Sequence
  COX-2__Homo_sapiens__Q6ZYK7
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKALHASVFQDRS

SEQ ID NO: 303 - protein, 543 aa, Artificial Sequence
  CP1B1__Homo_sapiens__Q16678
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 304 - protein, 110 aa, Artificial Sequence
  CSAG2__Homo_sapiens__Q9Y5P2-2
MWMGLIQLVEGVKRKDQGFLEKEFYHKTNIKMRCEFLACWPAFTVLGEAWRDQVDWSRLLRDAGLVKMSRKPRASSPLSNNHPPTPKRFPRQPGREKGPIKEVPGTKGSP

SEQ ID NO: 305 - protein, 127 aa, Artificial Sequence
  CSAG2__Homo_sapiens__Q9Y5P2
MWMGLIQLVEGVKRKDQGFLEKEFYHKTNIKMRCEFLACWPAFTVLGEAWRDQVDWSRLLRDAGLVKMSRKPRASSPLSNNHPPTPKRRGSGRHPLNPGPEALSKFPRQPGREKGPIKEVPGTKGSP

SEQ ID NO: 306 - protein, 189 aa, Artificial Sequence
  CT45A1__Homo_sapiens__Q5HYN5
MTDKTEKVAVDPETVFKRPRECDSPSYQKRQRMALLARKQGAGDSLIAGSAMSKAKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 307 - protein, 264 aa, Artificial Sequence
  CT55__Homo_sapiens__Q8WUE5
MLRLLRLALAFYGRTADPAERQGPQQQGLPQGDTQLTTVQGVVTSFCGDYGMIDESIYFSSDVVTGNVPLKVGQKVNVVVEEDKPHYGLRAIKVDVVPRHLYGAGPSDSGTRVLIGCVTSINEDNIYISNSIYFSIAIVSEDFVPYKGDLLEVEYSTEPGISNIKATSVKPIRCIHTEEVCITSVHGRNGVIDYTIFFTLDSVKLPDGYVPQVDDIVNVVMVESIQFCFIWRAISITPVHKSSSGFQDDGGLGRPKRERRSQSI

SEQ ID NO: 308 - protein, 947 aa, Artificial Sequence
  CT-_9/BRD6__Homo_sapiens__Q58F21
MSLPSRQTAIIVNPPPPEYINTKKNGRLTNQLQYLQKVVLKDLWKHSFSWPFQRPVDAVKLQLPDYYTIIKNPMDLNTIKKRLENKYYAKASECIEDFNTMFSNCYLYNKPGDDIVLMAQALEKLFMQKLSQMPQEEQVVGVKERIKKGTQQNIAVSSAKEKSSPSATEKVFKQQEIPSVFPKTSISPLNVVQGASVNSSSQTAAQVTKGVKRKADTTTPATSAVKASSEFSPTFTEKSVALPPIKENMPKNVLPDSQQQYNVVKTVKVTEQLRHCSEILKEMLAKKHFSYAWPFYNPVDVNALGLHNYYDVVKNPMDLGTIKEKMDNQEYKDAYKFAADVRLMFMNCYKYNPPDHEVVTMARMLQDVFETHFSKIPIEPVESMPLCYIKTDITETTGRENTNEASSEGNSSDDSEDERVKRLAKLQEQLKAVHQQLQVLSQVPFRKLNKKKEKSKKEKKKEKVNNSNENPRKMCEQMRLKEKSKRNQPKKRKQQFIGLKSEDEDNAKPMNYDEKRQLSLNINKLPGDKLGRVVHIIQSREPSLSNSNPDEIEIDFETLKASTLRELEKYVSACLRKRPLKPPAKKIMMSKEELHSQKKQELEKRLLDVNNQLNSRKRQTKSDKTQPSKAVENVSRLSESSSSSSSSSESESSSSDLSSSDSSDSESEMFPKFTEVKPNDSPSKENVKKMKNECIPPEGRTGVTQIGYCVQDTTSANTTLVHQTTPSHVMPPNHHQLAFNYQELEHLQTVKNISPLQILPPSGDSEQLSNGITVMHPSGDSDTTMLESECQAPVQKDIKIKNADSWKSLGKPVKPSGVMKSSDELFNQFRKAAIEKEVKARTQELIRKHLEQNTKELKASQENQRDLGNGLTVESFSNKIQNKCSGEEQKEHQQSSEAQDKSKLWLLKDRDLARQKEQERRRREAMVGTIDMTLQSDIMTMFENNFD

SEQ ID NO: 309 - protein, 180 aa, Artificial Sequence
  CTAG2_Isoform_LAGE-1A__Homo_sapiens__O75638-2
MQAEGRGTGGSTGDADGPGGPGIPDGPGGNAGGPGEAGATGGRGPRGAGAARASGPRGGAPRGPHGGAASAQDGRCPCGARRPDSRLLELHITMPFSSPMEAELVRRILSRDAAPLPRPGAVLKDFTVSGNLLFIRLTAADHRQLQLSISSCLQQLSLLMWITQCFLPVFLAQAPSGQRR

SEQ ID NO: 310 - protein, 210 aa, Artificial Sequence; identical to SEQ ID NO: 191
  CTAG2_Isoform_LAGE-1B__Homo_sapiens__O75638

SEQ ID NO: 311 - protein, 663 aa, Artificial Sequence
  CTCFL__Homo_sapiens__Q8NI51
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 312 - protein, 715 aa, Artificial Sequence
  Cten__Homo_sapiens__Q8IZW8
MSQVMSSPLLAGGHAVSLAPCDEPRRTLHPAPSPSLPPQCSYYTTEGWGAQALMAPVPCMGPPGRLQQAPQVEAKATCFLPSPGEKALGTPEDLDSYIDFSLESLNQMILELDPTFQLLPPGTGGSQAELAQSTMSMRKKEESEALDIKYIEVTSARSRCHDGPQHCSSPSVTPPFGSLRSGGLLLSRDVPRETRSSSESLIFSGNQGRGHQRPLPPSEGLSPRPPNSPSISIPCMGSKASSPHGLGSPLVASPRLEKRLGGLAPQRGSRISVLSASPVSDVSYMFGSSQSLLHSSNSSHQSSSRSLESPANSSSSLHSLGSVSLCTRPSDFQAPRNPTLTMGQPRTPHSPPLAKEHASSCPPSITNSMVDIPIVLINGCPEPGSSPPQRTPGHQNSVQPGAASPSNPCPATRSNSQTLSDAPFTTCPEGPARDMQPTMKFVMDTSKYWFKPNITREQAIELLRKEEPGAFVIRDSSSYRGSFGLALKVQEVPASAQSRPGEDSNDLIRHFLIESSAKGVHLKGADEEPYFGSLSAFVCQHSIMALALPCKLTIPQRELGGADGASDSTDSPASCQKKSAGCHTLYLSSVSVETLTGALAVQKAISTTFERDILPTPTVVHFKVTEQGITLTDVQRKVFFRRHYPLTTLRFCGMDPEQRKWQKYCKPSWIFGFVAKSQTEPQENVCHLFAEYDMVQPASQVIGLVTALLQDAERM

SEQ ID NO: 313 - protein, 433 aa, Artificial Sequence
  cyclin_B1__Homo_sapiens__P14635
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 314 - protein, 295 aa, Artificial Sequence
  cyclin_D1__Homo_sapiens__P24385
MEHQLLCCEVETIRRAYPDANLLNDRVLRAMLKAEETCAPSVSYFKCVQKEVLPSMRKIVATWMLEVCEEQKCEEEVFPLAMNYLDRFLSLEPVKKSRLQLLGATCMFVASKMKETIPLTAEKLCIYTDNSIRPEELLQMELLLVNKLKWNLAAMTPHDFIEHFLSKMPEAEENKQIIRKHAQTFVALCATDVKFISNPPSMVAAGSVVAAVQGLNLRSPNNFLSYYRLTRFLSRVIKCDPDCLRACQEQIEALLESSLRQAQQNMDPKAAEEEEEEEEEVDLACTPTDVRDVDI

SEQ ID NO: 315 - protein, 216 aa, Artificial Sequence
  cyp-B__Homo_sapiens__P23284
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 316 - protein, 347 aa, Artificial Sequence
  DAM-10__Homo_sapiens__P43366
MPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 317 - protein, 811 aa, Artificial Sequence
  DEP1A__Homo_sapiens__Q5TB30
MESQGVPPGPYRATKLWNEVTTSFRAGMPLRKHRQHFKKYGNCFTAGEAVDWLYDLLRNNSNFGPEVTRQQTIQLLRKFLKNHVIEDIKGRWGSENVDDNNQLFRFPATSPLKTLPRRYPELRKNNIENFSKDKDSIFKLRNLSRRTPKRHGLHLSQENGEKIKHEIINEDQENAIDNRELSQEDVEEVWRYVILIYLQTILGVPSLEEVINPKQVIPQYIMYNMANTSKRGVVILQNKSDDLPHWVLSAMKCLANWPRSNDMNNPTYVGFERDVFRTIADYFLDLPEPLLTFEYYELFVNILVVCGYITVSDRSSGIHKIQDDPQSSKFLHLNNLNSFKSTECLLLSLLHREKNKEESDSTERLQISNPGFQERCAKKMQLVNLRNRRVSANDIMGGSCHNLIGLSNMHDLSSNSKPRCCSLEGIVDVPGNSSKEASSVFHQSFPNIEGQNNKLFLESKPKQEFLLNLHSEENIQKPFSAGFKRTSTLTVQDQEELCNGKCKSKQLCRSQSLLLRSSTRRNSYINTPVAEIIMKPNVGQGSTSVQTAMESELGESSATINKRLCKSTIELSENSLLPASSMLTGTQSLLQPHLERVAIDALQLCCLLLPPPNRRKLQLLMRMISRMSQNVDMPKLHDAMGTRSLMIHTFSRCVLCCAEEVDLDELLAGRLVSFLMDHHQEILQVPSYLQTAVEKHLDYLKKGHIENPGDGLFAPLPTYSYCKQISAQEFDEQKVSTSQAAIAELLENIIKNRSLPLKEKRKKLKQFQKEYPLIYQKRFPTTESEAALFGDKPTIKQPMLILRKPKFRSLR

SEQ ID NO: 318 - protein, 98 aa, Artificial Sequence
  E7__Human_papillomavirus_type_16__P03129
MHGDTPTLHEYMLDLQPETTDLYCYEQLNDSSEEEDEIDGPAGQAEPDRAHYNIVTFCCKCDSTLRLCVQSTHVDIRTLEDLLMGTLGIVCPICSQKP

SEQ ID NO: 319 - protein, 105 aa, Artificial Sequence
  E7__Human_papillomavirus_type_18__P06788
MHGPKATLQDIVLHLEPQNEIPVDLLCHEQLSDSEEENDEIDGVNHQHLPARRAEPQRHTMLCMCCKCEARIKLVVESSADDLRAFQQLFLNTLSFVCPWCASQQ

SEQ ID NO: 320 - protein, 98 aa, Artificial Sequence
  E7__Human_papillomavirus_type_31__P17387
MRGETPTLQDYVLDLQPEATDLHCYEQLPDSSDEEDVIDSPAGQAEPDTSNYNIVTFCCQCKSTLRLCVQSTQVDIRILQELLMGSFGIVCPNCSTRL

SEQ ID NO: 321 - protein, 97 aa, Artificial Sequence
  E7__Human_papillomavirus_type_33__P06429
MRGHKPTLKEYVLDLYPEPTDLYCYEQLSDSSDEDEGLDRPDGQAQPATADYYIVTCCHTCNTTVRLCVNSTASDLRTIQQLLMGTVNIVCPTCAQQ

SEQ ID NO: 322 - protein, 99 aa, Artificial Sequence
  E7__Human_papillomavirus_type_35__P27230
MHGEITTLQDYVLDLEPEATDLYCYEQLCDSSEEEEDTIDGPAGQAKPDTSNYNIVTSCCKCEATLRLCVQSTHIDIRKLEDLLMGTFGIVCPGCSQRA

SEQ ID NO: 323 - protein, 109 aa, Artificial Sequence
  E7__Human_papillomavirus_type_39__P24837
MRGPKPTLQEIVLDLCPYNEIQPVDLVCHEQLGESEDEIDEPDHAVNHQHQLLARRDEPQRHTIQCSCCKCNNTLQLVVEASRDTLRQLQQLFMDSLGFVCPWCATANQ

SEQ ID NO: 324 - protein, 106 aa, Artificial Sequence
  E7__Human_papillomavirus_type_45__P21736
MHGPRETLQEIVLHLEPQNELDPVDLLCYEQLSESEEENDEADGVSHAQLPARRAEPQRHKILCVCCKCDGRIELTVESSAEDLRTLQQLFLSTLSFVCPWCATNQ

SEQ ID NO: 325 - protein, 101 aa, Artificial Sequence
  E7__Human_papillomavirus_type_51__P26558
MRGNVPQLKDVVLHLTPQTEIDLQCYEQFDSSEEEDEVDNMRDQLPERRAGQATCYRIEAPCCRCSSVVQLAVESSGDTLRVVQQMLMGELSLVCPCCANN

SEQ ID NO: 326 - protein, 99 aa, Artificial Sequence
  E7__Human_papillomavirus_type_52__P36831
MRGDKATIKDYILDLQPETTDLHCYEQLGDSSDEEDTDGVDRPDGQAEQATSNYYIVTYCHSCDSTLRLCIHSTATDLRTLQQMLLGTLQVVCPGCARL

SEQ ID NO: 327 - protein, 105 aa, Artificial Sequence
  E7__Human_papillomavirus_type_56__P36833
MHGKVPTLQDVVLELTPQTEIDLQCNEQLDSSEDEDEDEVDHLQERPQQARQAKQHTCYLIHVPCCECKFVVQLDIQSTKEDLRVVQQLLMGALTVTCPLCASSN

SEQ ID NO: 328 - protein, 98 aa, Artificial Sequence
  E7__Human_papillomavirus_type_58__Q9QCZ1
MRGNNPTLREYILDLHPEPTDLFCYEQLCDSSDEDEIGLDRPDGQAQPATANYYIVTCCYTCDTTVRLCINSTTTDVRTLQQLLMGTCTIVCPSCAQQ

SEQ ID NO: 329 - protein, 107 aa, Artificial Sequence
  E7__Human_papillomavirus_type_59__Q81965
MHGPKATLCDIVLDLEPQNYEEVDLVCYEQLPDSDSENEKDEPDGVNHPLLLARRAEPQRHNIVCVCCKCNNQLQLVVETSQDGLRALQQLFMDTLSFVCPLCAANQ

SEQ ID NO: 330 - protein, 105 aa, Artificial Sequence
  E7__Human_papillomavirus_type_66__Q80956
MHGKVPTLQEVILELAPQTEIDLQCNEQLDSSEDEDEDEIDHLLERPQQARQAEQHKCYLIHVPCCKCELVVQLDIQSTKEELRVVQQLLMGALTVTCPLCASSK

SEQ ID NO: 331 - protein, 463 aa, Artificial Sequence
  EF1A2__Homo_sapiens__Q05639
MGKEKTHINIVVIGHVDSGKSTTTGHLIYKCGGIDKRTIEKFEKEAAEMGKGSFKYAWVLDKLKAERERGITIDISLWKFETTKYYITIIDAPGHRDFIKNMITGTSQADCAVLIVAAGVGEFEAGISKNGQTREHALLAYTLGVKQLIVGVNKMDSTEPAYSEKRYDEIVKEVSAYIKKIGYNPATVPFVPISGWHGDNMLEPSPNMPWFKGWKVERKEGNASGVSLLEALDTILPPTRPTDKPLRLPLQDVYKIGGIGTVPVGRVETGILRPGMVVTFAPVNITTEVKSVEMHHEALSEALPGDNVGFNVKNVSVKDIRRGNVCGDSKSDPPQEAAQFTSQVIILNHPGQISAGYSPVIDCHTAHIACKFAELKEKIDRRSGKKLEDNPKSLKSGDAAIVEMVPGKPMCVESFSQYPPLGRFAVRDMRQTVAVGVIKNVEKKSGGAGKVTKSAQKAQKAGK

SEQ ID NO: 332 - protein, 972 aa, Artificial Sequence
  EFTUD2/m__Homo_sapiens__Q15029
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSELIRNVTLCGHLHHGKTCFVDCLIEQTHPEIRKRYDQDLCYTDILFTEQERGVGIKSTPVTVVLPDTKGKSYLFNIMDTPGHVNFSDEVTAGLRISDGVVLFIDAAEGVMLNTERLIKHAVQERLAVTVCINKIDRLILELKLPPTDAYYKLRHIVDEVNGLISMYSTDENLILSPLLGNVCFSSSQYSICFTLGSFAKIYADTFGDINYQEFAKRLWGDIYFNPKTRKFTKKAPTSSSQRSFVEFILEPLYKILAQVVGDVDTSLPRTLDELGIHLTKEELKLNIRPLLRLVCKKFFGEFTGFVDMCVQHIPSPKVGAKPKIEHTYTGGVDSDLGEAMSDCDPDGPLMCHTTKMYSTDDGVQFHAFGRVLSGTIHAGQPVKVLGENYTLEDEEDSQICTVGRLWISVARYHIEVNRVPAGNWVLIEGVDQPIVKTATITEPRGNEEAQIFRPLKFNTTSVIKIAVEPVNPSELPKMLDGLRKVNKSYPSLTTKVEESGEHVILGTGELYLDCVMHDLRKMYSEIDIKVADPVVTFCETVVETSSLKCFAETPNKKNKITMIAEPLEKGLAEDIENEVVQITWNRKKLGEFFQTKYDWDLLAARSIWAFGPDATGPNILVDDTLPSEVDKALLGSVKDSIVQGFQWGTREGPLCDELIRNVKFKILDAVVAQEPLHRGGGQIIPTARRVVYSAFLMATPRLMEPYYFVEVQAPADCVSAVYTVLARRRGHVTQDAPIPGSPLYTIKAFIPAIDSFGFETDLRTHTQGQAFSLSVFHHWQIVPGDPLDKSIVIRPLEPQPAPHLAREFMIKTRRRKGLSEDVSISKFFDDPMLLELAKQDVVLNYPM

SEQ ID NO: 333 - protein, 657 aa, Artificial Sequence
  EGFR__Homo_sapiens__A0A0B4J1Y5
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGSYIVSHFPRSFYKMSVH

SEQ ID NO: 334 - protein, 1136 aa, Artificial Sequence
  EGFR__Homo_sapiens__E7BSV0
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 335 - protein, 49 aa, Artificial Sequence
  EGFR__Homo_sapiens__L0R6G1
MCATCAIQTAPTGPNKSSLSDFSLPLKLHFLSTISISPFASNKVLTLFI

SEQ ID NO: 336 - protein, 405 aa, Artificial Sequence
  EGFR__Homo_sapiens__P00533-2
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 337 - protein, 1210 aa, Artificial Sequence [sequence omitted]

SEQ ID NO: 338 - protein, 464 aa, Artificial Sequence [sequence omitted]

SEQ ID NO: 339 - protein, 1091 aa, Artificial Sequence
  EGFR__Homo_sapiens__Q504U8
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQGQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEPLTPSGEAPNQALLRILKETEFKKIKVLGSGAFGTVYKGLWIPEGEKVKIPVAIKELREATSPKANKEILDEAYVMASVDNPHVCRLLGICLTSTVQLITQLMPFGCLLDYVREHKDNIGSQYLLNWCVQIAKGMNYLEDRRLVHRDLAARNVLVKTPQHVKITDFGLAKLLGAEEKEYHAEGGKVPIKWMALESILHRIYTHQSDVWSYGVTVWELMTFGSKPYDGIPASEISSILEKGERLPQPPICTIDVYMIMVKCWMIDADSRPKFRELIIEFSKMARDPQRYLVIQGDERMHLPSPTDSNFYRALMDEEDMDDVVDADEYLIPQQGFFSSPSTSRTPLLSSLSATSNNSTVACIDRNGLQSCPIKEDSFLQRYSSDPTGALTEDSIDDTFLPVPGEWLVWKQSCSSTSSTHSAAASLQCPSQVLPPASPEGETVADLQTQ

SEQ ID NO: 340 - protein, 71 aa, Artificial Sequence
  EGFR__Homo_sapiens__Q8NDU8
MRPSGTAGAALLALLAALCPASRALEEKKGKGVSRRLPRRPRIAPRTPQPAQPRTGAPARARAPARPFLFP

SEQ ID NO: 341 - protein, 239 aa, Artificial Sequence
  EGLN3__Homo_sapiens__Q9H6Z9
MPLGHIMRLDLEKIALEYIVPCLHEVGFCYLDNFLGEVVGDCVLERVKQLHCTGALRDGQLAGPRAGVSKRHLRGDQITWIGGNEEGCEAISFLLSLIDRLVLYCGSRLGKYYVKERSKAMVACYPGNGTGYVRHVDNPNGDGRCITCIYYLNKNWDAKLHGGILRIFPEGKSFIADVEPIFDRLLFFWSDRRNPHEVQPSYATRYAMTVWYFDAEERAEAKKKFRNLTRKTESALTED

SEQ ID NO: 342 - protein, 521 aa, Artificial Sequence
  ELF2/m__Homo_sapiens__B7Z720
MATSLHEGPTNQLDLLIRAVEASVHSSNAHCTDKTIEAAEALLHMESPTCLRDSRSPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 343 - protein, 269 aa, Artificial Sequence
  EMMPRIN__Homo_sapiens__Q54A51
MAAALFVLLGFALLGTHGASGAAGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 344 - protein, 314 aa, Artificial Sequence
  EpCam__Homo_sapiens__P16422
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 345 - protein, 976 aa, Artificial Sequence
  EphA2__Homo_sapiens__P29317
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 346 - protein, 983 aa, Artificial Sequence
  EphA3__Homo_sapiens__P29320
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 347 - protein, 983 aa, Artificial Sequence [sequence omitted]

SEQ ID NO: 348 - protein, 462 aa, Artificial Sequence
  ErbB3__Homo_sapiens__B3KWG5
MPMSTILPVTSPCLPATGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 349 - protein, 921 aa, Artificial Sequence
  ErbB3__Homo_sapiens__B4DGQ7
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGQCIWMPSLPSLAPVSNLPFETPS

SEQ ID NO: 350 - protein, 1308 aa, Artificial Sequence
  ERBB4__Homo_sapiens__Q15303
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 351 - protein, 486 aa, Artificial Sequence
  ERG__Homo_sapiens__P11308
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 352 - protein, 452 aa, Artificial Sequence
  ETV6__Homo_sapiens__P41212
MSETPAQCSIKQERISYTPPESPVPSYASSTPLHVPVPRALRMEEDSIRLPAHLRLQPIYWSRDDVAQWLKWAENEFSLRPIDSNTFEMNGKALLLLTKEDFRYRSPHSGDVLYELLQHILKQRKPRILFSPFFHPGNSIHTQPEVILHQNHEEDNCVQRTPRPSVDNVHHNPPTIELLHRSRSPITTNHRPSPDPEQRPLRSPLDNMIRRLSPAERAQGPRPHQENNHQESYPLSVSPMENNHCPASSESHPKPSSPRQESTRVIQLMPSPIMHPLILNPRHSVDFKQSRLSEDGLHREGKPINLSHREDLAYMNHIMVSVSPPEEHAMPIGRIADCRLLWDYVYQLLSDSRYENFIRWEDKESKIFRIVDPNGLARLWGNHKNRTNMTYEKMSRALRHYYKLNIIRKEPGQRLLFRFMKTPDEIMSGRTDRLEHLESQELDEQIYQEDEC

SEQ ID NO: 353 - protein, 656 aa, Artificial Sequence
  EWS__Homo_sapiens__Q01844
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 354 - protein, 665 aa, Artificial Sequence
  EZH2__Homo_sapiens__F2YMM1
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKGQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 355 - protein, 334 aa, Artificial Sequence
  EZH2__Homo_sapiens__G3XAL2
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLPLLPRN

SEQ ID NO: 356 - protein, 64 aa, Artificial Sequence
  EZH2__Homo_sapiens__L0R855
MPLVNIMMMTMMMMETILKKEKKSRKIWRITEMIKKAAHLGNFLLIKFLKPFPQCFQIRAQQKN

SEQ ID NO: 357 - protein, 746 aa, Artificial Sequence
  EZH2__Homo_sapiens__Q15910
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 358 - protein, 707 aa, Artificial Sequence
  EZH2__Homo_sapiens__S4S3R8
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 359 - protein, 132 aa, Artificial Sequence
  FABP7__Homo_sapiens__O15540
MVEAFCATWKLTNSQNFDEYMKALGVGFATRQVGNVTKPTVIISQEGDKVVIRTLSTFKNTEISFQLGEEFDETTADDRNCKSVVSLDGDKLVHIQKWDGKETNFVREIKDGKMVMTLTFGDVVAVRHYEKA

SEQ ID NO: 360 - protein, 254 aa, Artificial Sequence
  FCGR3A_Version_1__Homo_sapiens__P08637
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 361 - protein, 290 aa, Artificial Sequence
  FCGR3A_Version_2__Homo_sapiens__CCDS1232.1
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 362 - protein, 268 aa, Artificial Sequence
  FGF5__Homo_sapiens__P12034
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 363 - protein, 38 aa, Artificial Sequence
  FGF5__Homo_sapiens__Q60518
MSTRCGEAGRARGTQPHRGYRAQNQPYKMHLGPPRLEE

SEQ ID NO: 364 - protein, 821 aa, Artificial Sequence
  FGFR2__Homo_sapiens__P21802
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 365 - protein, 635 aa, Artificial Sequence
  fibronectin__Homo_sapiens__A0A024R5I6
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 366 - protein, 1098 aa, Artificial Sequence
  fibronectin__Homo_sapiens__A0A024RB01
MPPRQPPRQAGGGLSREFGKLLPALSHSPLGGLGSGSGSVAPGQGRAGAMGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 367 - protein, 1198 aa, Artificial Sequence
  fibronectin__Homo_sapiens__A0A024RDT9
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 368 - protein, 1142 aa, Artificial Sequence
  fibronectin__Homo_sapiens__A0A024RDV5
MSGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 369 - protein, 339 aa, Artificial Sequence
  fibronectin__Homo_sapiens__A6NH44
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 370 - protein, 1049 aa, Artificial Sequence [sequence omitted]

SEQ ID NO: 371 - protein, 1049 aa, Artificial Sequence [sequence omitted]

SEQ ID NO: 372 - protein, 466 aa, Artificial Sequence
  fibronectin__Homo_sapiens__B3KXM5
MLSLRQRMMHARFRNPLSRQPARPSYRQGYNGRPNVEGKVLPGSNGKPNGQRIINGPQGTKWVVDLDRGLVLNAEGRYLQDSHGNPLRIKLGGDGRTIVDLEGTPVVSPDGLPLFGQGRHGTPLANAQDKPILSLGGKPLVGLEVIKKTTHPPTTTMQPTTTTTPLPTTTTPRPTTATTRRTTTRRPTTTVRTTTRTTTTTTPKPTTPIPTCPPGTLERHDDDGNLIMSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPI

SEQ ID NO: 373 - protein, 156 aa, Artificial Sequence
  fibronectin__Homo_sapiens__B4DIC5
MEEQRNEEIQSFIYSLKQMLLNVEANSAKVQEDLEAEFQSLFSLLEELKEGMLMKIKQDRASRTYELQNQLAACTRALESSEELLETANQTLQAMDSEDFPQAAKQIKDGVTMAPAFRLSLKAKVSDNMSHLMVDFAQERQMLQALKFLPGERGTH

SEQ ID NO: 374 - protein, 306 aa, Artificial Sequence
  fibronectin__Homo_sapiens__B4DN21
MIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 375 - protein, 639 aa, Artificial Sequence [sequence omitted]

SEQ ID NO: 376 - protein, 337 aa, Artificial Sequence [sequence omitted]

SEQ ID NO: 377 - protein, 1014 aa, Artificial Sequence [sequence omitted]

SEQ ID NO: 378 - protein, 894 aa, Artificial Sequence [sequence omitted]

SEQ ID NO: 379 - protein, 383 aa, Artificial Sequence
  fibronectin__Homo_sapiens__B7Z3W5
MASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGSVHVTSLKKHTSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 380 - protein, 146 aa, Artificial Sequence
  fibronectin__Homo_sapiens__B7Z939
MPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTSEYSDRPHSPLSRSMEMTSNLEKIFCLSFGLTRSRNDTIFKHCNNIC

SEQ ID NO: 381 - protein, 684 aa, Artificial Sequence
  fibronectin__Homo_sapiens__G5E9X3
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQTPSG

SEQ ID NO: 382 - protein, 163 aa, Artificial Sequence
  fibronectin__Homo_sapiens__Q9H382
MSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 383 - protein, 380 aa, Artificial Sequence
  FOS__Homo_sapiens__P01100
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADSFPSCAAAHRKGSSSNEPSSDSLSSPTLLAL

SEQ ID NO: 384 - protein, 431 aa, Artificial Sequence
  FOXP3__Homo_sapiens__Q9BZS1
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 385 - protein, 365 aa, Artificial Sequence
  FUT1__Homo_sapiens__P19526
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 386 - protein, 459 aa, Artificial Sequence
  G250__Homo_sapiens__Q16790
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 387 - protein, 138 aa, Artificial Sequence
  GAGE-1__Homo_sapiens__AAA82744
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEEMRSHYVAQTGILWLLMNNCFLNLSPRKP

SEQ ID NO: 388 - protein, 116 aa, Artificial Sequence
  GAGE-2__Homo_sapiens__Q6NT46
MSWRGRSTYRPRPRRYVEPPEMIGPMRPEQFSDEVEPATPEEGEPATQRQDPAAAQEGQDEGASAGQGPKPEAHSQEQGHPQTGCECEDGPDGQEMDPPNPEEVKTPEEGEKQSQC

SEQ ID NO: 389 - protein, 118 aa, Artificial Sequence
  GAGE-3__Homo_sapiens__Q13067
MNLSRGKSTYYWPRPRRYVQPPEVIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 390 - protein, 117 aa, Artificial Sequence
  GAGE-4__Homo_sapiens__Q13068
MSWRGRSTYYWPRPRRYVQPPEMIGPMRPEQFSDEVEPATPEEGEPATQRQDPAAAQEGEDEGASAGQGPKPEADSQEQGHPQTGCECEDGPDGQEMDPPNPEEVKTPEEGEGQSQC

SEQ ID NO: 391 - protein, 117 aa, Artificial Sequence
  GAGE-5__Homo_sapiens__Q13069
MSWRGRSTYYWPRPRRYVQPPEVIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 392 - protein, 117 aa, Artificial Sequence
  GAGE-6__Homo_sapiens__Q13070
MSWRGRSTYYWPRPRRYVQPPEVIGPMRPEQFSDEVEPATPEEGEPATQRQDPAAAQEGEDEGASAGQGPKPEADSQEQGHPQTGCECEDGPDGQEVDPPNPEEVKTPEEGEKQSQC

SEQ ID NO: 393 - protein, 117 aa, Artificial Sequence
  GAGE7b__Homo_sapiens__O76087
MSWRGRSTYYWPRPRRYVQPPEMIGPMRPEQFSDEVEPATPEEGEPATQRQDPAAAQEGEDEGASAGQGPKPEAHSQEQGHPQTGCECEDGPDGQEMDPPNPEEVKTPEEGEKQSQC

SEQ ID NO: 394 - protein, 116 aa, Artificial Sequence
  GAGE-8_(GAGE-2D)__Homo_sapiens__Q9UEU5
MSWRGRSTYRPRPRRYVEPPEMIGPMRPEQFSDEVEPATPEEGEPATQRQDPAAAQEGEDEGASAGQGPKPEADSQEQGHPQTGCECEDGPDGQEMDPPNPEEVKTPEEGEKQSQC

SEQ ID NO: 395 - protein, 447 aa, Artificial Sequence
  GASR__Homo_sapiens__P32239
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 396 - protein, 741 aa, Artificial Sequence
  GnT-V__Homo_sapiens__Q09328
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 397 - protein, 580 aa, Artificial Sequence
  GPC3__Homo_sapiens__I6QTG3
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 398 - protein, 580 aa, Artificial Sequence; identical to SEQ ID NO: 397
  GPC3__Homo_sapiens__P51654

SEQ ID NO: 399 - protein, 580 aa, Artificial Sequence [sequence omitted]

SEQ ID NO: 400 - protein, 560 aa, Artificial Sequence
  GPNMB/m__Homo_sapiens__A0A024RA55
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 401 - protein, 572 aa, Artificial Sequence
  GPNMB/m__Homo_sapiens__Q14956
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 402 - protein, 206 aa, Artificial Sequence [sequence omitted]

SEQ ID NO: 403 - protein, 206 aa, Artificial Sequence
  GPNMB/m__Homo_sapiens__Q96F58
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGWLLQTPKLLLYLSLKFQPSLFLLYN

SEQ ID NO: 404 - protein, 879 aa, Artificial Sequence
  GRM3__Homo_sapiens__Q14832
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 405 - protein, 648 aa, Artificial Sequence
  HAGE__Homo_sapiens__Q9NXZ2
MSHHGGAPKASTWVVASRRSSTVSRAPERRPAEELNRTGPEGYSVGRGGRWRGTSRPPEAVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWADLPPIKKNFYKESTATSAMSKVEADSWRKENFNITWDDLKDGEKRPIPNPTCTFDDAFQCYPEVMENIKKAGFQKPTPIQSQAWPIVLQGIDLIGVAQTGTGKTLCYLMPGFIHLVLQPSLKGQRNRPGMLVLTPTRELALQVEGECCKYSYKGLRSVCVYGGGNRDEQIEELKKGVDIIIATPGRLNDLQMSNFVNLKNITYLVLDEADKMLDMGFEPQIMKILLDVRPDRQTVMTSATWPHSVHRLAQSYLKEPMIVYVGTLDLVAVSSVKQNIIVTTEEEKWSHMQTFLQSMSSTDKVIVFVSRKAVADHLSSDLILGNISVESLHGDREQRDREKALENFKTGKVRILIATDLASRGLDVHDVTHVYNFDFPRNIEEYVHRIGRTGRAGRTGVSITTLTRNDWRVASELINILERANQSIPEELVSMAERFKAHQQKREMERKMERPQGRPKKFH

SEQ ID NO: 406 - protein, 402 aa, Artificial Sequence
  hepsin__Homo_sapiens__B2ZDQ2
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQ

SEQ ID NO: 407 - protein, 417 aa, Artificial Sequence
  hepsin__Homo_sapiens__P05981
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 408 - protein, 979 aa, Artificial Sequence
  Her2/neu__Homo_sapiens__B4DTR1
MELAALCRWGLLLALLPPGAASTQDNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 409 - protein, 87 aa, Artificial Sequence
  Her2/neu__Homo_sapiens__L8E8G2
MMRMKTFVMIHFHLMNGGKAKLYSRPHAKLLPEQRVTDKTGAPVEWPGQTQCSTETQTLAAMPAQAVMRVTCTVVDMHKSECAPAQT

SEQ ID NO: 410 - protein, 1255 aa, Artificial Sequence [sequence omitted]

SEQ ID NO: 411 - protein, 419 aa, Artificial Sequence
  Her2/neu__Homo_sapiens__Q9UK79
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARGTHSLPPRPAAVPVPLRMQPGPAHPVLSFLRPSWDLVSAFYSLPLAPLSPTSVPISPVSVGRGPDPDAHVAVDLSRYEG

SEQ ID NO: 412 - protein, 182 aa, Artificial Sequence
  HLA-A2/m__Homo_sapiens__Q95387
GSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWETAHVAEQLRAYLEGTCVEWLRRYLENGKETLQRT

SEQ ID NO: 413 - protein, 181 aa, Artificial Sequence
  HLA-A2/m__Homo_sapiens__Q9MYF8
SHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRT

SEQ ID NO: 414 - protein, 234 aa, Artificial Sequence
  homeobox_NKX3.1__Homo_sapiens__Q99801
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 415 - protein, 313 aa, Artificial Sequence
  HOM-TES-85__Homo_sapiens__B2RBQ6
MASFRKLTLSEKVPPNHPSRKKVNFLDMSLDDIIIYKELEGTNAEEEKNKRQNHSKKESPSRQQSKAHRHRHRRDYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 416 - protein, 313 aa, Artificial Sequence
  HOM-TES-85__Homo_sapiens__Q9P127
MASFRKLTLSEKVPPNHPSRKKVNFLDMSLDDIIIYKELEGTNAEEEKNKRQNHSKKESPSRQQSKAHRHRHRRGYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 417 - protein, 127 aa, Artificial Sequence
  HPG1__Homo_sapiens__12543784
MIKKNLKKLGIEETYLNIIKAIYDRPTASIQKTENLSTKTGTSQEYHLSPLWFYIVLEILASTIRQEKNLKDIHTEKEEVKLSLFADAMILYLKKPNDSTRKLLELIKKIHSSCRIKINIHFAFCSQ

SEQ ID NO: 418 - protein, 641 aa, Artificial Sequence
  HS71A__Homo_sapiens__P0DMV8
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 419 - protein, 641 aa, Artificial Sequence; identical to SEQ ID NO: 418
  HS71B__Homo_sapiens__P0DMV9

SEQ ID NO: 420 - protein, 208 aa, Artificial Sequence
  HST-2__Homo_sapiens__P10767
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 421 - protein, 523 aa, Artificial Sequence
  hTERT__Homo_sapiens__O94807
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPILTGARRLVETIFLGSSPGCQGLPAGCPACPSATGKCGPCFWSCLGTTRSAPTGCSSRRTARCELRSPQQPVSVPGRSPRALWRPPRRRTQTPVAWCSCSASTAPLAGVRLRAGLPAPAGAPRPLGLQAQRRRFLRNTKKFISLGKHAKLSLQELTWKMSVRDCAWLRRSP

SEQ ID NO: 422 - protein, 559 aa, Artificial Sequence
  iCE__Homo_sapiens__O00748
MRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 423 - protein, 579 aa, Artificial Sequence
  IF2B3__Homo_sapiens__O00425
MNKLYIGNLSENAAPSDLESIFKDAKIPVSGPFLVKTGYAFVDCPDESWALKAIEALSGKIELHGKPIEVEHSVPKRQRIRKLQIRNIPPHLQWEVLDSLLVQYGVVESCEQVNTDSETAVVNVTYSSKDQARQALDKLNGFQLENFTLKVAYIPDEMAAQQNPLQQPRGRRGLGQRGSSRQGSPGSVSKQKPCDLPLRLLVPTQFVGAIIGKEGATIRNITKQTQSKIDVHRKENAGAAEKSITILSTPEGTSAACKSILEIMHKEAQDIKFTEEIPLKILAHNNFVGRLIGKEGRNLKKIEQDTDTKITISPLQELTLYNPERTITVKGNVETCAKAEEEIMKKIRESYENDIASMNLQAHLIPGLNLNALGLFPPTSGMPPPTSGPPSAMTPPYPQFEQSETETVHLFIPALSVGAIIGKQGQHIKQLSRFAGASIKIAPAEAPDAKVRMVIITGPPEAQFKAQGRIYGKIKEENFVSPKEEVKLEAHIRVPSFAAGRVIGKGGKTVNELQNLSSAEVVVPRDQTPDENDQVVVKITGHFYACQVAQRKIQEILTQVKQHQQQKALQSGPPQSRRK

SEQ ID NO: 424 - protein, 380 aa, Artificial Sequence
  IL-13Ra2__Homo_sapiens__Q14627
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 425 - protein, 272 aa, Artificial Sequence
  IL2-RA__Homo_sapiens__P01589
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 426 - protein, 551 aa, Artificial Sequence
  IL2-RB__Homo_sapiens__P14784
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 427 - protein, 369 aa, Artificial Sequence
  IL2-RG__Homo_sapiens__P31785
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 428 - protein, 184 aa, Artificial Sequence
  IMP3__Homo_sapiens__Q9NV31
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 429 - protein, 1049 aa, Artificial Sequence
  ITA5__Homo_sapiens__P08648
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 430 - protein, 798 aa, Artificial Sequence
  ITB1__Homo_sapiens__P05556
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 431 - protein, 788 aa, Artificial Sequence
  ITB6__Homo_sapiens__P18564
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 432 - protein, 261 aa, Artificial Sequence
  kallikrein-2__Homo_sapiens__A0A024R4J4
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGGDSGGPLVCNGVLQGITSWGPEPCALPEKPAVYTKVVHYRKWIKDTIAANP

SEQ ID NO: 433 - protein, 223 aa, Artificial Sequence
  kallikrein-2__Homo_sapiens__A0A024R4N3
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHLLSNDMCARAYSEKVTEFMLCAGLWTGGKDTCGVSHPYSQHLEGKG

SEQ ID NO: 434 - protein, 62 aa, Artificial Sequence
  kallikrein-2__Homo_sapiens__B0AZU9
MSLLKHQSLRPDEDSSHDLMLLRLSEPAKITDVVKVLGLPTQEPALGTTCYASGWGSIEPEE

SEQ ID NO: 435 - protein, 244 aa, Artificial Sequence [sequence omitted]

SEQ ID NO: 436 - protein, 261 aa, Artificial Sequence; identical to SEQ ID NO: 432
  kallikrein-2__Homo_sapiens__P20151

SEQ ID NO: 437 - protein, 49 aa, Artificial Sequence
  kallikrein-2__Homo_sapiens__Q6T774
MWDLVLSIALSVGCTGIARSGWVGTTCLSLKTQARGSLSATASHTRSTI

SEQ ID NO: 438 - protein, 180 aa, Artificial Sequence
  kallikrein-2__Homo_sapiens__Q6T775
MWDLVLSIALSVGCTGAVPLIQSRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEECTPGPDGVAGSPDAWV

SEQ ID NO: 439 - protein, 254 aa, Artificial Sequence
  kallikrein-4__Homo_sapiens__A0A0C4DFQ5
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGQDQKDSCNGDSGGPLICNGYLQGLVSFGKAPCGQVGVPGVYTNLCKFTEWIEKTVQAS

SEQ ID NO: 440 - protein, 75 aa, Artificial Sequence
  kallikrein-4__Homo_sapiens__Q5BQA0
MATAGNPWGWFLGYLILGVAGSLVSGSCSQIINGEDCSPHSQPWQAALVMENELFCSGVLVHPQWVLSAAHCFQK

SEQ ID NO: 441 - protein, 195 aa, Artificial Sequence
  kallikrein-4__Homo_sapiens__Q96PT0
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGELTGVCLPSSRRSSAQSRGLTQSSASQAECLPCCSA

SEQ ID NO: 442 - protein, 159 aa, Artificial Sequence
  kallikrein-4__Homo_sapiens__Q96PT1
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANG

SEQ ID NO: 443 - protein, 254 aa, Artificial Sequence
  kallikrein-4__Homo_sapiens__Q9Y5K2
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGHDQKDSCNGDSGGPLICNGYLQGLVSFGKAPCGQVGVPGVYTNLCKFTEWIEKTVQAS

SEQ ID NO: 444 - protein, 890 aa, Artificial Sequence
  KI20A__Homo_sapiens__O95235
MSQGILSPPAGLLSDDDVVVSPMFESTAADLGSVVRKNLLSDCSVVSTSLEDKQQVPSEDSMEKVKVYLRVRPLLPSELERQEDQGCVRIENVETLVLQAPKDSFALKSNERGIGQATHRFTFSQIFGPEVGQASFFNLTVKEMVKDVLKGQNWLIYTYGVTNSGKTHTIQGTIKDGGILPRSLALIFNSLQGQLHPTPDLKPLLSNEVIWLDSKQIRQEEMKKLSLLNGGLQEEELSTSLKRSVYIESRIGTSTSFDSGIAGLSSISQCTSSSQLDETSHRWAQPDTAPLPVPANIRFSIWISFFEIYNELLYDLLEPPSQQRKRQTLRLCEDQNGNPYVKDLNWIHVQDAEEAWKLLKVGRKNQSFASTHLNQNSSRSHSIFSIRILHLQGEGDIVPKISELSLCDLAGSERCKDQKSGERLKEAGNINTSLHTLGRCIAALRQNQQNRSKQNLVPFRDSKLTRVFQGFFTGRGRSCMIVNVNPCASTYDETLHVAKFSAIASQLVHAPPMQLGFPSLHSFIKEHSLQVSPSLEKGAKADTGLDDDIENEADISMYGKEELLQVVEAMKTLLLKERQEKLQLEMHLRDEICNEMVEQMQQREQWCSEHLDTQKELLEEMYEEKLNILKESLTSFYQEEIQERDEKIEELEALLQEARQQSVAHQQSGSELALRRSQRLAASASTQQLQEVKAKLQQCKAELNSTTEELHKYQKMLEPPPSAKPFTIDVDKKLEEGQKNIRLLRTELQKLGESLQSAERACCHSTGAGKLRQALTTCDDILIKQDQTLAELQNNMVLVKLDLRKKAACIAEQYHTVLKLQGQVSAKKRLGTNQENQQPNQQPPGKKPFLRNLLPRTPTCQSSTDCSPYARILRSRRSPLLKSGPFGKKY

SEQ ID NO: 445 - protein, 370 aa, Artificial Sequence
  KIAA0205__Homo_sapiens__Q92604
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 446 - protein, 725 aa, Artificial Sequence
  KIF2C__Homo_sapiens__Q99661
MAMDSSLQARLFPGLAIKIQRSNGLIHSANVRTVNLEKSCVSVEWAEGGATKGKEIDFDDVAAINPELLQLLPLHPKDNLPLQENVTIQKQKRRSVNSKIPAPKESLRSRSTRMSTVSELRITAQENDMEVELPAAANSRKQFSVPPAPTRPSCPAVAEIPLRMVSEEMEEQVHSIRGSSSANPVNSVRRKSCLVKEVEKMKNKREEKKAQNSEMRMKRAQEYDSSFPNWEFARMIKEFRATLECHPLTMTDPIEEHRICVCVRKRPLNKQELAKKEIDVISIPSKCLLLVHEPKLKVDLTKYLENQAFCFDFAFDETASNEVVYRFTARPLVQTIFEGGKATCFAYGQTGSGKTHTMGGDLSGKAQNASKGIYAMASRDVFLLKNQPCYRKLGLEVYVTFFEIYNGKLFDLLNKKAKLRVLEDGKQQVQVVGLQEHLVNSADDVIKMIDMGSACRTSGQTFANSNSSRSHACFQIILRAKGRMHGKFSLVDLAGNERGADTSSADRQTRMEGAEINKSLLALKECIRALGQNKAHTPFRESKLTQVLRDSFIGENSRTCMIATISPGISSCEYTLNTLRYADRVKELSPHSGPSGEQLIQMETEEMEACSNGALIPGNLSKEEEELSSQMSSFNEAMTQIRELEEKAMEELKEIIQQGPDWLELSEMTEQPDYDLETFVNKAESALAQQAKHFSALRDVIKALRLAMQLEEQASRQISSKKRPQ

SEQ ID NO: 447 - protein, 113 aa, Artificial Sequence
  KK-LC-1__Homo_sapiens__Q5H943
MNFYLLLASSILCALIVFWKYRRFQRNTGEMSSNSTALALVRPSSSGLINSNTDNNLAVYDLSRDILNNFPHSIARQKRILVNLSMVENKLVELEHTLLSKGFRGASPHRKST

SEQ ID NO: 448 - protein, 860 aa, Artificial Sequence [sequence omitted]

SEQ ID NO: 449 - protein, 433 aa, Artificial Sequence
  LGMN__Homo_sapiens__Q99538
MVWKVAVFLSVALGIGAVPIDDPEDGGKHWVVIVAGSNGWYNYRHQADACHAYQIIHRNGIPDEQIVVMMYDDIAYSEDNPTPGIVINRPNGTDVYQGVPKDYTGEDVTPQNFLAVLRGDAEAVKGIGSGKVLKSGPQDHVFIYFTDHGSTGILVFPNEDLHVKDLNETIHYMYKHKMYRKMVFYIEACESGSMMNHLPDNINVYATTAANPRESSYACYYDEKRSTYLGDWYSVNWMEDSDVEDLTKETLHKQYHLVKSHTNTSHVMQYGNKTISTMKVMQFQGMKRKASSPVPLPPVTHLDLTPSPDVPLTIMKRKLMNTNDLEESRQLTEEIQRHLDARHLIEKSVRKIVSLLAASEAEVEQLLSERAPLTGHSCYPEALLHFRTHCFNWHSPTYEYALRHLYVLVNLCEKPYPLHRIKLSMDHVCLGHY

SEQ ID NO: 450 - protein, 598 aa, Artificial Sequence
  LIRB2__Homo_sapiens__Q8N423
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 451 - protein, 165 aa, Artificial Sequence
  LY6K__Homo_sapiens__Q17RY6
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 452 - protein, 124 aa, Artificial Sequence
  MAGA5__Homo_sapiens__P43359
MSLEQKSQHCKPEEGLDTQEEALGLVGVQAATTEEQEAVSSSSPLVPGTLGEVPAAGSPGPLKSPQGASAIPTAIDFTLWRQSIKGSSNQEEEGPSTSPDPESVFRAALSKKVADLIHFLLLKY

SEQ ID NO: 453 - protein, 318 aa, Artificial Sequence
  MAGA8__Homo_sapiens__P43361
MLLGQKSQRYKAEEGLQAQGEAPGLMDVQIPTAEEQKAASSSSTLIMGTLEEVTDSGSPSPPQSPEGASSSLTVTDSTLWSQSDEGSSSNEEEGPSTSPDPAHLESLFREALDEKVAELVRFLLRKYQIKEPVTKAEMLESVIKNYKNHFPDIFSKASECMQVIFGIDVKEVDPAGHSYILVTCLGLSYDGLLGDDQSTPKTGLLIIVLGMILMEGSRAPEEAIWEALSVMGLYDGREHSVYWKLRKLLTQEWVQENYLEYRQAPGSDPVRYEFLWGPRALAETSYVKVLEHVVRVNARVRISYPSLHEEALGEEKGV

SEQ ID NO: 454 - protein, 429 aa, Artificial Sequence
  MAGAB__Homo_sapiens__P43364
METQFRRGGLGCSPASIKRKKKREDSGDFGLQVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 455 - protein, 369 aa, Artificial Sequence
  MAGE-A10__Homo_sapiens__A0A024RC14
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIKNYEDHFPLLFSEASECMLLVFGIDVKEVDPTGHSFVLVTSLGLTYDGMLSDVQSMPKTGILILILSIIFIEGYCTPEEVIWEALNMMGLYDGMEHLIYGEPRKLLTQDWVQENYLEYRQVPGSDPARYEFLWGPRAHAEIRKMSLLKFLAKVNGSDPRSFPLWYEEALKDEEERAQDRIATTDDTTAMASASSSATGSFSYPE

SEQ ID NO: 456 - protein, 314 aa, Artificial Sequence
  MAGE-A12__Homo_sapiens__P43365
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 457 - protein, 309 aa, Artificial Sequence
  MAGE-A1__Homo_sapiens__P43355
MSLEQRSLHCKPEEALEAQQEALGLVCVQAATSSSSPLVLGTLEEVPTAGSTDPPQSPQGASAFPTTINFTRQRQPSEGSSSREEEGPSTSCILESLFRAVITKKVADLVGFLLLKYRAREPVTKAEMLESVIKNYKHCFPEIFGKASESLQLVFGIDVKEADPTGHSYVLVTCLGLSYDGLLGDNQIMPKTGFLIIVLVMIAMEGGHAPEEEIWEELSVMEVYDGREHSAYGEPRKLLTQDLVQEKYLEYRQVPDSDPARYEFLWGPRALAETSYVKVLEYVIKVSARVRFFFPSLREAALREEEEGV

SEQ ID NO: 458 - protein, 314 aa, Artificial Sequence
  MAGE-A2__Homo_sapiens__P43356
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 459 - protein, 314 aa, Artificial Sequence; identical to SEQ ID NO: 192
  MAGE-A3__Homo_sapiens__P43357

SEQ ID NO: 460 - protein, 317 aa, Artificial Sequence
  MAGE-A4__Homo_sapiens__A0A024RC12
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 461 - protein, 317 aa, Artificial Sequence; identical to SEQ ID NO: 460
  MAGE-A4__Homo_sapiens__P43358

SEQ ID NO: 462 - protein, 317 aa, Artificial Sequence
  MAGE-A4__Homo_sapiens__Q1RN33
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPTSNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 463 - protein, 314 aa, Artificial Sequence [sequence omitted]

SEQ ID NO: 464 - protein, 314 aa, Artificial Sequence
  MAGE-A6__Homo_sapiens__P43360
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGREDSIFGDPKKLLTQYFVQENYLEYRQVPGSDPACYEFLWGPRALIETSYVKVLHHMVKISGGPRISYPLLHEWALREGEE

SEQ ID NO: 465 - protein, 314 aa, Artificial Sequence [sequence omitted]

SEQ ID NO: 466 - protein, 315 aa, Artificial Sequence
  MAGE-A9__Homo_sapiens__P43362
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 467 - protein, 347 aa, Artificial Sequence
  MAGE-B10__Homo_sapiens__Q96LZ2
MPRGQKSKLRAREKRRQARGGLEDLIDALDILEEEEESPPSASACLKDVFQSSLDGASNNPHGLREAQSTSTSATAASHTRHPEGVNDQMEERPICTQDLEATDSFPRGPVDEKVIILVHYLLYKYQMKEPITKADMLRNVTQMSKSQFPVILSRASEHLELIFGLDLKEVEPNKHIYVLVNKLDLGCDAKLSDETGVPKTGLLMTVLGIIFTNGNCVAEEEVWKVFNTMGLYDGIEHFMFGEPRKLLTKDLVKENYLEYQQVPNSDPPRYQFLWGPRAHAETSKMKVLEFLAKVNDTAPSEFSNWYTEALQDEEERARARVAAKARVSATAGARSKVKSSKSSQLQ

SEQ ID NO: 468 - protein, 324 aa, Artificial Sequence
  MAGE-B16__Homo_sapiens__A2A368
MSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 469 - protein, 336 aa, Artificial Sequence
  MAGE-B17__Homo_sapiens__A8MXT2
MPRGQASKRRAREKRRQARGEDQCLGGAQATAAEKEKLPSSSSPACQSPPQSFPNAGIPQESQRASYPSSPASAVSLTSSDEGAKGQKGESPNSFHGPSSSESTGRDLLNTKTGELVQFLLNKYIRKEPITREAMLKVINRKYKQHFPEILRRSTENVEVVFGLYLKEMDPSRQSYVLVGKLDFPNQGSLSDGGGFPLSGLLMVLLSTIFMHGNRATEEEMWECLNALGMYKGRKHFIYGEPQELVTKDLVREGYLEYQQVPSSDPPRYEFLWGPRARAETSKMKVLEFVAKLNDTVASTYKSRYEEALREEEEQARARAVARDSARARASRSFQP

SEQ ID NO: 470 - protein, 347 aa, Artificial Sequence [sequence omitted]

SEQ ID NO: 471 - protein, 319 aa, Artificial Sequence
  MAGE-B2__Homo_sapiens__O15479
MPRGQKSKLRAREKRRKARDETRGLNVPQVTEAEEEEAPCCSSSVSGGAASSSPAAGIPQEPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 472 - protein, 346 aa, Artificial Sequence
  MAGE-B3__Homo_sapiens__O15480
MPRGQKSTLHAREKRQQTRGQTQDHQGAQITATNKKKVSFSSPLILGATIQKKSAGRSRSALKKPQRALSTTTSVDVSYKKSYKGANSKIEKKQSFSQGLSSTVQSRTDPLIMKTNMLVQFLMEMYKMKKPIMKADMLKIVQKSHKNCFPEILKKASFNMEVVFGVDLKKVDSTKDSYVLVSKMDLPNNGTVTRGRGFPKTGLLLNLLGVIFMKGNCATEEKIWEFLNKMRIYDGKKHFIFGEPRKLITQDLVKLKYLEYRQVPNSNPARYEFLWGPRAHAETSKMKVLEFWAKVNKTVPSAFQFWYEEALRDEEERVQAAAMLNDGSSAMGRKCSKAKASSSSHA

SEQ ID NO: 473 - protein, 346 aa, Artificial Sequence
  MAGE-B4__Homo_sapiens__O15481
MPRGQKSKLRAREKRQRTRGQTQDLKVGQPTAAEKEESPSSSSSVLRDTASSSLAFGIPQEPQREPPTTSAAAAMSCTGSDKGDESQDEENASSSQASTSTERSLKDSLTRKTKMLVQFLLYKYKMKEPTTKAEMLKIISKKYKEHFPEIFRKVSQRTELVFGLALKEVNPTTHSYILVSMLGPNDGNQSSAWTLPRNGLLMPLLSVIFLNGNCAREEEIWEFLNMLGIYDGKRHLIFGEPRKLITQDLVQEKYLEYQQVPNSDPPRYQFLWGPRAHAETSKMKVLEFLAKVNDTTPNNFPLLYEEALRDEEERAGARPRVAARRGTTAMTSAYSRATSSSSSQPM

SEQ ID NO: 474 - protein, 275 aa, Artificial Sequence
  MAGE-B5__Homo_sapiens__Q9BZ81
MTSAGVFNAGSDERANSRDEEYPCSSEVSPSTESSCSNFINIKVGLLEQFLLYKFKMKQRILKEDMLKIVNPRYQNQFAEIHRRASEHIEVVFAVDLKEVNPTCHLYDLVSKLKLPNNGRIHVGKVLPKTGLLMTFLVVIFLKGNCANKEDTWKFLDMMQIYDGKKYYIYGEPRKLITQDFVRLTYLEYHQVPCSYPAHYQFLWGPRAYTETSKMKVLEYLAKVNDIAPGAFSSQYEEALQDEEESPSQRCSRNWHYCSGQDCLRAKFSSFSQPY

SEQ ID NO: 475 - protein, 407 aa, Artificial Sequence
  MAGE-B6__Homo_sapiens__Q8N7X4
MPRGHKSKLRTCEKRQETNGQPQGLTGPQATAEKQEESHSSSSSSRACLGDCRRSSDASIPQESQGVSPTGSPDAVVSYSKSDVAANGQDEKSPSTSRDASVPQESQGASPTGSPDAGVSGSKYDVAANGQDEKSPSTSHDVSVPQESQGASPTGSPDAGVSGSKYDVAAEGEDEESVSASQKAIIFKRLSKDAVKKKACTLAQFLQKKFEKKESILKADMLKCVRREYKPYFPQILNRTSQHLVVAFGVELKEMDSSGESYTLVSKLGLPSEGILSGDNALPKSGLLMSLLVVIFMNGNCATEEEVWEFLGLLGIYDGILHSIYGDARKIITEDLVQDKYVVYRQVCNSDPPCYEFLWGPRAYAETTKMRVLRVLADSSNTSPGLYPHLYEDALIDEVERALRLRA

SEQ ID NO: 476 - protein, 1142 aa, Artificial Sequence
  MAGE-C1__Homo_sapiens__O60732
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESTQSPFEGFPQSVLQIPVSAASSSTLVSIFQSSPESTQSPFEGFPQSPLQIPVSRSFSSTLLSIFQSSPERTQSTFEGFAQSPLQIPVSPSSSSTLLSLFQSFSERTQSTFEGFAQSSLQIPVSPSFSSTLVSLFQSSPERTQSTFEGFPQSPLQIPVSSSSSSTLLSLFQSSPERTHSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 477 - protein, 373 aa, Artificial Sequence
  MAGE-C2__Homo_sapiens__Q9UBF1
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 478 - protein, 643 aa, Artificial Sequence
  MAGE-C3__Homo_sapiens__Q8TD91
MLLPCHWVLDATFSDGSLGQWVKNTCATYALSPVVLPPQPQPRKKATDKDYSAFHLGHLREVRLFLRGGTSDQRMDSLVLCPTYFKLWRTLSGSPGLQLSDLHFGSQPEGKFSLRRAVSVKQREEPQDWPLNEKRTLWKDSDLPTWRRGTGYTLSLPAVSPGKRLWGEKAGSLPESEPLFTYTLDEKVDKLVQFLLLKYQAKEPLTRAEMQMNVINTYTGYFPMIFRKAREFIEILFGISLTEVDPDHFYVFVNTLDLTCEGSLSDEQGMPQNRLLILILSVIFIKGNCASEEVIWEVLNAIGPWSALAGFADVLSRLALWESEGPEAFCEESGLRSAEGSVLDLANPQGLAGHRQEDGRRGLTEASPQQKKGGEDEDMPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGPIQRPAREVLEFLSKLSSIIPSAFPSWYMDALKDMEDRAQAIIDTTDDATAMASASPSVMSTNFCPE

SEQ ID NO: 479 - protein, 778 aa, Artificial Sequence
  MAGE-D1__Homo_sapiens__Q9Y5V3
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 480 - protein, 606 aa, Artificial Sequence
  MAGE-D2__Homo_sapiens__Q9UNF1
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 481 - protein, 741 aa, Artificial Sequence
  MAGE-D4__Homo_sapiens__Q96JG8
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 482 - protein, 373 aa, Artificial Sequence [sequence omitted]

SEQ ID NO: 483 - protein, 957 aa, Artificial Sequence
  MAGE-E1_(MAGE1)__Homo_sapiens__Q9HCI5
MSLVSQNSRRRRRRVAKATAHNSSWGEMQAPNAPGLPADVPGSDVPQGPSDSQILQGLCASEGPSTSVLPTSAEGPSTFVPPTISEASSASGQPTISEGPGTSVLPTPSEGLSTSGPPTISKGLCTSVTLAASEGRNTSRPPTSSEEPSTSVPPTASEVPSTSLPPTPGEGTSTSVPPTAYEGPSTSVVPTPDEGPSTSVLPTPGEGPGTSVPLAATEGLSTSVQATPDEGPSTSVPPTATEGLSTPVPPTRDEGPSTSVPATPGEGPSTSVLPAASDGQSISLVPTRGKGSSTSVPPTATEGLSTSVQPTAGEGSSTSVPPTPGGGLSTSVPPTATEELSTSVPPTPGEGPSTSVLPIPGEGLSTSVPPTASDGSDTSVPPTPGEGASTLVQPTAPDGPGSSVLPNPGEGPSTLFSSSASVDRNPSKCSLVLPSPRVTKASVDSDSEGPKGAEGPIEFEVLRDCESPNSISIMGLNTSRVAITLKPQDPMEQNVAELLQFLLVKDQSKYPIRESEMREYIVKEYRNQFPEILRRAAAHLECIFRFELRELDPEAHTYILLNKLGPVPFEGLEESPNGPKMGLLMMILGQIFLNGNQAKEAEIWEMLWRMGVQRERRLSIFGNPKRLLSVEFVWQRYLDYRPVTDCKPVEYEFFWGPRSHLETTKMKILKFMAKIYNKDPMDWPEKYNEALEEDAARAFAEGWQALPHFRRPFFEEAAAEVPSPDSEVSSYSSKYAPHSWPESRLESKARKLVQLFLLMDSTKLPIPKKGILYYIGRECSKVFPDLLNRAARTLNHVYGTELVVLDPRNHSYTLYNRREMEETEEIVDSPNRPGNNFLMQVLSFIFIMGNHARESAVWAFLRGLGVQAGRKHVITCRYLSQRYIDSLRVPDSDPVQYEFVWGPRARLETSKMKALRYVARIHRKEPQDWPQQYREAMEDEANRADVGHRQIFVHNFR

SEQ ID NO: 484 - protein, 523 aa, Artificial Sequence
  MAGE-E2__Homo_sapiens__Q8TD90
MSLVSQNARHCSAEITADYGDGRGEIQATNASGSPTSMLVVDAPQCPQAPINSQCVNTSQAVQDPNDLEVLIDEQSRRLGALRVHDPLEDRSIALVNFMRMKSQTEGSIQQSEMLEFLREYSDQFPEILRRASAHLDQVFGLNLRVIDPQADTYNLVSKRGFQITDRIAESLDMPKASLLALVLGHILLNGNRAREASIWDLLLKVDMWDKPQRINNLFGNTRNLLTTDFVCMRFLEYWPVYGTNPLEFEFLWGSRAHREITKMEALKFVSDAHDEEPWSWPEEYNKALEGDKTKERSLTAGLEFWSEDTMNDKANDLVQLAISVTEEMLPIHQDELLAHTGKEFEDVFPNILNRATLILDMFYGLSLIEVDTSEHIYLLVQQPESEEEQVMLESLGRPTQEYVMPILGLIFLMGNRVKEANVWNLLRRFSVDVGRKHSITRKLMRQRYLECRPLSYSNPVEYELLWGPRAHHETIKMKVLEYMARLYRKRPQNWPEQYREAVEDEEARAKSEATIMFFLDPT

SEQ ID NO: 485 - protein, 307 aa, Artificial Sequence
  MAGE-F1__Homo_sapiens__Q9HAY2
MLQTPESRGLPVPQAEGEKDGGHDGETRAPTASQERPKEELGAGREEGAAEPALTRKGARALAAKALARRRAYRRLNRTVAELVQFLLVKDKKKSPITRSEMVKYVIGDLKILFPDIIARAAEHLRYVFGFELKQFDRKHHTYILINKLKPLEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 486 - protein, 219 aa, Artificial Sequence
  MAGE-H1__Homo_sapiens__Q9H213
MPRGRKSRRRRNARAAEENRNNRKIQASEASETPMAASVVASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 487 - protein, 1249 aa, Artificial Sequence
  MAGEL2__Homo_sapiens__Q9UJ55
MSQLSKNLGDSSPPAEAPKPPVYSRPTVLMRAPPASSRAPPVPWDPPPIDLQASLAAWQAPQPAWEAPQGQLPAPVVPMTQPPALGGPIVPAPPLGGPMGKPPTPGVLMVHPPPPGAPMAQPPTPGVLMVHPSAPGAPMAHPPPPGTPMSHPPPPGTPMAHPPPPGTPMAHPPPPGTPMVHPPPPGTPMAHPPPPGTPMAHPPPPGTPMAHPPPPGTPMAHPPPPGTPMAQPPAPGVLMAQPLTPGVLMVQPAAPGAPMVQPPPAAMMTQPQPSGAPMAKPPGPGVLMIHPPGARAPMTQPPASGAPMAQPAAPPAQPMAPPAQPMASWAPQAQPLILQIQSQVIRAPPQVPQGPQAPPAQLATPPGWQATSPGWQATQQGWQATPLTWQTTQVTWQAPAVTWQVPPPMRQGPPPIRPGPPPIRPGPPPVRQAPPLIRQAPPVIRQAPPVIRQAPPVIRQAPAVIRQAPPVIRQAPPVIRQAPPVIRQAPPLIRQAPPPIRPAPQVLATQPPLWQALPPPPPLRQAPQARLPAPQVQAAPQVPTAPPATQVPAAPPAGPQVPQPVLPAPLSAPLSAPQAVHCPSIIWQAPKGQPPVPHEIPTSMEFQEVQQTQALAWQAQKAPTHIWQPLPAQEAQRQAPPLVQLEQPFQGAPPSQKAVQIQLPPQQAQASGPQAEVPTLPLQPSWQAPPAVLQAQPGPPVAAANFPLGSAKSLMTPSGECRASSIDRRGSSKERRTSSKERRAPSKDRMIFAATFCAPKAVSAARAHLPAAWKNLPATPETFAPSSSVFPATSQFQPASLNAFKGPSAASETPKSLPYALQDPFACVEALPAVPWVPQPNMNASKASQAVPTFLMATAAAPQATATTQEASKTSVEPPRRSGKATRKKKHLEAQEDSRGHTLAFHDWQGPRPWENLNLSDWEVQSPIQVSGDWEHPNTPRGLSGWEGPSTSRILSGWEGPSASWALSAWEGPSTSRALGLSESPGSSLPVVVSEVASVSPGSSATQDNSKVEAQPLSPLDERANALVQFLLVKDQAKVPVQRSEMVKVILREYKDECLDIINRANNKLECAFGYQLKEIDTKNHAYIIINKLGYHTGNLVASYLDRPKFGLLMVVLSLIFMKGNCVREDLIFNFLFKLGLDVRETNGLFGNTKKLITEVFVRQKYLEYRRIPYTEPAEYEFLWGPRAFLETSKMLVLRFLAKLHKKDPQSWPFHYLEALAECEWEDTDEDEPDTGDSAHGPTSRPPPR

SEQ ID NO: 488 - protein, 93 aa, Artificial Sequence
  mammaglobin_A__Homo_sapiens__Q13296
MKLLMVLMLAALSQHCYAGSGCPLLENVISKTINPQVSKTEYKELLQEFIDDNATTNAIDELKECFLNQTDETLSNVEVFMQLIYDSSLCDLF

SEQ ID NO: 489 - protein, 120 aa, Artificial Sequence
  mammaglobin_A__Homo_sapiens__Q6NX70
MKLLMVLMLAALSQHCYAGSGCPLLENVISKTINPQVSKTEYKELLQEFIDDNATTNAIDELKECFLNQTDETLSNVEVFMVISFSSYKLFKSPDQGQVGSSFLTDNAKATSEQAFSYIG

SEQ ID NO: 490 - protein, 118 aa, Artificial Sequence
  MART-1/melan-A__Homo_sapiens__Q16655
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 491 - protein, 493 aa, Artificial Sequence
  MART-2__Homo_sapiens__Q5VTY9
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 492 - protein, 317 aa, Artificial Sequence
  MC1_R__Homo_sapiens__Q01726
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 493 - protein, 317 aa, Artificial Sequence; identical to SEQ ID NO: 492
  MC1_R__Homo_sapiens__Q1JUL4

SEQ ID NO: 494 - protein, 317 aa, Artificial Sequence
  MC1_R__Homo_sapiens__Q1JUL6
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARQAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 495 - protein, 317 aa, Artificial Sequence
  MC1_R__Homo_sapiens__Q1JUL8
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVTDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 496 - protein, 317 aa, Artificial Sequence [sequence omitted]

SEQ ID NO: 497 - protein, 317 aa, Artificial Sequence [sequence omitted]

SEQ ID NO: 498 - protein, 317 aa, Artificial Sequence [sequence omitted]

SEQ ID NO: 499 - protein, 317 aa, Artificial Sequence [sequence omitted]

SEQ ID NO: 500 - protein, 317 aa, Artificial Sequence [sequence omitted]

SEQ ID NO: 501 - protein, 316 aa, Artificial Sequence
  MC1_R__Homo_sapiens__Q1JUM5
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIYALRYHSIVTLPRARQAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 502 - protein, 317 aa, Artificial Sequence [sequence omitted]

SEQ ID NO: 503 - protein, 317 aa, Artificial Sequence [sequence omitted]

SEQ ID NO: 504 - protein, 317 aa, Artificial Sequence [sequence omitted]

SEQ ID NO: 505 - protein, 317 aa, Artificial Sequence [sequence omitted]

SEQ ID NO: 506 - protein, 317 aa, Artificial Sequence [sequence omitted]

SEQ ID NO: 507 - protein, 317 aa, Artificial Sequence [sequence omitted]

SEQ ID NO: 508 - protein, 317 aa, Artificial Sequence [sequence omitted]

SEQ ID NO: 509 - protein, 317 aa, Artificial Sequence [sequence omitted]

SEQ ID NO: 510 - protein, 317 aa, Artificial Sequence [sequence omitted]

SEQ ID NO: 511 - protein, 317 aa, Artificial Sequence [sequence omitted]

SEQ ID NO: 512 - protein, 317 aa, Artificial Sequence [sequence omitted]

SEQ ID NO: 513 - protein, 317 aa, Artificial Sequence [sequence omitted]

SEQ ID NO: 514 - protein, 317 aa, Artificial Sequence
  MC1_R__Homo_sapiens__V9Q7F1
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSTVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 515 - protein, 317 aa, Artificial Sequence [sequence omitted]

SEQ ID NO: 516 - protein, 317 aa, Artificial Sequence [sequence omitted]

SEQ ID NO: 517 - protein, 317 aa, Artificial Sequence [sequence omitted]

SEQ ID NO: 518 - protein, 317 aa, Artificial Sequence [sequence omitted]

SEQ ID NO: 519 - protein, 317 aa, Artificial Sequence [sequence omitted]

SEQ ID NO: 520 - protein, 317 aa, Artificial Sequence [sequence omitted]

SEQ ID NO: 521 - protein, 317 aa, Artificial Sequence [sequence omitted]

SEQ ID NO: 522 - protein, 317 aa, Artificial Sequence [sequence omitted]

SEQ ID NO: 523 - protein, 317 aa, Artificial Sequence [sequence omitted]

SEQ ID NO: 524 - protein, 317 aa, Artificial Sequence [sequence omitted]

SEQ ID NO: 525 - protein, 317 aa, Artificial Sequence [sequence omitted]

SEQ ID NO: 526 - protein, 317 aa, Artificial Sequence [sequence omitted]

SEQ ID NO: 527 - protein, 317 aa, Artificial Sequence [sequence omitted]

SEQ ID NO: 528 - protein, 317 aa, Artificial Sequence [sequence omitted]

SEQ ID NO: 529 - protein, 317 aa, Artificial Sequence [sequence omitted]

SEQ ID NO: 530 - protein, 317 aa, Artificial Sequence [sequence omitted]

SEQ ID NO: 531 - protein, 630 aa, Artificial Sequence
  mesothelin__Homo_sapiens__Q13421
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 532 - protein, 504 aa, Artificial Sequence
  MITF__Homo_sapiens__O75030-8
MEALRVQMFMPCSFESLYLSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 533 - protein, 419 aa, Artificial Sequence
  MITF__Homo_sapiens__O75030-9
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 534 - protein, 526 aa, Artificial Sequence
  MITF__Homo_sapiens__O75030
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 535 - protein, 354 aa, Artificial Sequence [sequence omitted]

SEQ ID NO: 536 - protein, 267 aa, Artificial Sequence
  MMP7__Homo_sapiens__P09237
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 537 - protein, 1255 aa, Artificial Sequence
  MUC-1__Homo_sapiens__AAA60019
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 538 - protein, 711 aa, Artificial Sequence
  MUM-1/m__Homo_sapiens__NP_116242
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 539 - protein, 145 aa, Artificial Sequence
  MUM-2/m__Homo_sapiens__Q9Y5R8
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALYVELVVKNPLCPLGQTVQSELFRSRLDSYVRSLPFFSARAG

SEQ ID NO: 540 - protein, 1043 aa, Artificial Sequence
  MYO1A__Homo_sapiens__Q9UBC5
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 541 - protein, 1136 aa, Artificial Sequence
  MYO1B__Homo_sapiens__O43795
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELRRLKEEARNKHAIAVIWAYWLGSKARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 542 - protein, 1063 aa, Artificial Sequence
  MYO1C__Homo_sapiens__O00159
MALQVELVPTGEIIRVVHPHRPCKLALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 543 - protein, 1006 aa, Artificial Sequence
  MYO1D__Homo_sapiens__O94832
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 544 - protein, 1108 aa, Artificial Sequence
  MYO1E__Homo_sapiens__Q12965
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYDAQDTDELSFNANDIIDIIKEDPSGWWTGRLRGKQGLFPNNYVTKI

SEQ ID NO: 545 - protein, 1098 aa, Artificial Sequence
  MYO1F__Homo_sapiens__O00160
MGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPLEIMSGGGTHRPPRGPPSTSLGASRRPRARPPSEHNTEFLNVPDQGMAGMQRKRSVGQRPVPGVGRPKPQPRTHGPRCRALYQYVGQDVDELSFNVNEVIEILMEDPSGWWKGRLHGQEGLFPGNYVEKI

SEQ ID NO: 546 - protein, 1018 aa, Artificial Sequence
  MYO1G__Homo_sapiens__B0I1T2
MEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDMHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLLQKAWRGTLARWRCRRLRAIYTIMRWFRRHKVRAHLAELQRRFQAARQPPLYGRDLVWPLPPAVLQPFQDTCHALFCRWRARQLVKNIPPSDMPQIKAKVAAMGALQGLRQDWGCRRAWARDYLSSATDNPTASSLFAQRLKTLQDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 547 - protein, 1022 aa, Artificial Sequence
  MYO1H__Homo_sapiens__NP_001094891
MEGALTARDKVGVQDFVLLDAYTSESAFVDNLRKRFSENLIYTYIGTLLVSVNPYQELGIYTVSQMELYQGVNFFELPPHVYAIADNAYRMMCAELNNHFILISGESGAGKTEASKKILEYFAVTCPMTQSLQIARDRLLFSNPVLEAFGNARTLRNDNSSRFGKYMDIQFDFQGIPVGGHIISYLIEKSRVVYQNEGERNFHIFYQLLAGGEEERLSYLGLERDPQLYKYLSQGHCAKESSISDKNDWKTVSNAFSVIDFTEADLENLFGIIASVLHLGNIGFEEDDQGCATIPDTHEIKWIAKLLGVHPSVLLEALTHRKIEAKTEEVICPLTLELSVYARDAMAKAVYGRTFTWLVNKINSSLVNKDFTRKTVIGLLDIYGFEVFDKNGFEQFCINYCNEKLQQLLIERTLKAEQAEYEMEGIEWEPIKYFNNKIICDLVEERHKGIISILDEECIRPGPATDLSFLEKLEEKVGKHAHFETRKLAGPKGRKRIGWMEFRLLHYAGEVTYCTKGFLEKNNDLLYRHLKEVLCKSKNIILRECFLLAELENRRRPPTVGTQFKNSLSSLLETLISKEPSYIRCIKPNDRKEPSKFDDFLIRHQIKYLGLMEHLRVRRAGFAYRRKYEHFLQRYKSLCPDTWPHWHGPPAEGVERLIKYIGYKPEEYKLGKTKIFIRFPRTLFATEDAFEFSKHQLVARIQATYKRCLGRREYVKKRQAAIKLEAHWRGALARKAIQRRKWAVRIIRKFIKGFISRNKPLCPDNEEFIVFVRKNYILNLRYHLPKTVLDKSWLRPPGILENASDLLRKMCVRNLVQKYCRGITAERKAMMQQKVVTSEIFRGRKDGYTESLNQPFVNSRIDEGDINPKVLQLISHEKIQYGVPVIKYDRKGFKARQRQLILTQKAAYVVELAKIKQKIEYSALKGVSTSNLSDGILVIHVSPEDSKQKGDAVLQCGHVFEAVTKLVMLVKKENIVNVVQGSLQFFISPGKEGTIVFDTGLEEQVYKNKNGQLTVVSVRRKS

SEQ ID NO: 548 - protein, 792 aa, Artificial Sequence
  NA17__Homo_sapiens__Q3V5L5
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKLQGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 549 - protein, 11 aa, Artificial Sequence
  NA88-A__Homo_sapiens__10790436
MTQGQHFLQKV

SEQ ID NO: 550 - protein, 736 aa, Artificial Sequence
  Neo-PAP__Homo_sapiens__Q9BWT3
MKEMSANTVLDSQRQQKHYGITSPISLASPKEIDHIYTQKLIDAMKPFGVFEDEEELNHRLVVLGKLNNLVKEWISDVSESKNLPPSVVATVGGKIFTFGSYRLGVHTKGADIDALCVAPRHVERSDFFQSFFEKLKHQDGIRNLRAVEDAFVPVIKFEFDGIEIDLVFARLAIQTISDNLDLRDDSRLRSLDIRCIRSLNGCRVTDEILHLVPNKETFRLTLRAVKLWAKRRGIYSNMLGFLGGVSWAMLVARTCQLYPNAAASTLVHKFFLVFSKWEWPNPVLLKQPEESNLNLPVWDPRVNPSDRYHLMPIITPAYPQQNSTYNVSTSTRTVMVEEFKQGLAVTDEILQGKSDWSKLLEPPNFFQKYRHYIVLTASASTEENHLEWVGLVESKIRVLVGNLERNEFITLAHVNPQSFPGNKEHHKDNNYVSMWFLGIIFRRVENAESVNIDLTYDIQSFTDTVYRQANNINMLKEGMKIEATHVKKKQLHHYLPAEILQKKKKQSLSDVNRSSGGLQSKRLSLDSSCLDSSRDTDNGTPFNSPASKSDSPSVGETERNSAEPAAVIVEKPLSVPPAQGLSIPVIGAKVDSTVKTVSPPTVCTIPTVVGRNVIPRITTPHNPAQGQPHLNGMSNITKTVTPKRSHSPSIDGTPKRLKDVEKFIRLESTFKDPRTAEERKRKSVDAIGGESMPIPTIDTSRKKRLPSKELPDSSSPVPANNIRVIKNSIRLTLNR

SEQ ID NO: 551 - protein, 458 aa, Artificial Sequence
  NFYC/m__Homo_sapiens__Q13952
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 552 - protein, 933 aa, Artificial Sequence
  NGEP__Homo_sapiens__Q6IWH7
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 553 - protein, 294 aa, Artificial Sequence
  NPM__Homo_sapiens__P06748
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKGGSLPKVEAKFINYVKNCFRMTDQEAIQDLWQWRKSL

SEQ ID NO: 554 - protein, 1304 aa, Artificial Sequence
  NRCAM__Homo_sapiens__Q92823
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 555 - protein, 434 aa, Artificial Sequence
  NSE__Homo_sapiens__P09104
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 556 - protein, 464 aa, Artificial Sequence
  NUF2__Homo_sapiens__Q9BZD4
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 557 - protein, 180 aa, Artificial Sequence; identical to SEQ ID NO: 151
  NY-ESO-1__Homo_sapiens__P78358

SEQ ID NO: 558 - protein, 404 aa, Artificial Sequence
  OA1__Homo_sapiens__P51810
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 559 - protein, 1046 aa, Artificial Sequence
  OGT__Homo_sapiens__O15294
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 560 - protein, 146 aa, Artificial Sequence [sequence omitted]

SEQ ID NO: 561 - protein, 406 aa, Artificial Sequence
  OS-9__Homo_sapiens__B4E321
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 562 - protein, 740 aa, Artificial Sequence
  OS-9__Homo_sapiens__B7Z8E7
MAVETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGRTLFHLFREIHFHFFPSPDLTVLTDWWGGGGVEKYHGPSSLGDRGGEGTPSYLLPSVSPLLSDQSLPVLCTLGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 563 - protein, 667 aa, Artificial Sequence
  OS-9__Homo_sapiens__Q13438
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 564 - protein, 100 aa, Artificial Sequence
  osteocalcin__Homo_sapiens__P02818
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 565 - protein, 314 aa, Artificial Sequence
  osteopontin__Homo_sapiens__A0A024RDE2
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 566 - protein, 300 aa, Artificial Sequence
  osteopontin__Homo_sapiens__A0A024RDE6
MRIAVICFCLLGITCAIPVKQADSGSSEEKQLYNKYPDAVATWLNPDPSQKQNLLAPQTLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 567 - protein, 287 aa, Artificial Sequence
  osteopontin__Homo_sapiens__A0A024RDJ0
MRIAVICFCLLGITCAIPVKQADSGSSEEKQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 568 - protein, 327 aa, Artificial Sequence
  osteopontin__Homo_sapiens__B7Z351
MGIVPRSLDKKAHRVQFQLNRIKAKIELPWGSLQLDCLMKTLKELYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 569 - protein, 292 aa, Artificial Sequence
  osteopontin__Homo_sapiens__F2YQ21
MRIAVICFCLLGITCAIPVKQADSGSSEEKQLYNKYPDAVATWLNPDPSQKQNLLAPQNAVSSEETNDFKQETLPSKSNESHDHMDDMDDEDDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 570 - protein, 314 aa, Artificial Sequence; identical to SEQ ID NO: 565
  osteopontin__Homo_sapiens__P10451

SEQ ID NO: 571 - protein, 393 aa, Artificial Sequence [sequence omitted]

SEQ ID NO: 572 - protein, 102 aa, Artificial Sequence
  PAGE-4__Homo_sapiens__O60829
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 573 - protein, 402 aa, Artificial Sequence [sequence omitted]

SEQ ID NO: 574 - protein, 415 aa, Artificial Sequence
  PAI-2__Homo_sapiens__P05120
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILELPYAGDVSMFLLLPDEIADVSTGLELLESEITYDKLNKWTSKDKMAEDEVEVYIPQFKLEEHYELRSILRSMGMEDAFNKGRANFSGMSERNDLFLSEVFHQAMVDVNEEGTEAAAGTGGVMTGRTGHGGPQFVADHPFLFLIMHKITNCILFFGRFSSP

SEQ ID NO: 575 - protein, 175 aa, Artificial Sequence
  PAP__Homo_sapiens__Q06141
MLPPMALPSVSWMLLSCLMLLSQVQGEEPQRELPSARIRCPKGSKAYGSHCYALFLSPKSWTDADLACQKRPSGNLVSVLSGAEGSFVSSLVKSIGNSYSYVWIGLHDPTQGTEPNGEGWEWSSSDVMNYFAWERNPSTISSPGHCASLSRSTAFLRWKDYNCNVRLPYVCKFTD

SEQ ID NO: 576 - protein, 175 aa, Artificial Sequence; identical to SEQ ID NO: 575
  PAP__Homo_sapiens__Q53S56

SEQ ID NO: 577 - protein, 126 aa, Artificial Sequence
  PATE__Homo_sapiens__Q8WXA2
MDKSLLLELPILLCCFRALSGSLSMRNDAVNEIVAVKNNFPVIEIVQCRMCHLQFPGEKCSRGRGICTATTEEACMVGRMFKRDGNPWLTFMGCLKNCADVKGIRWSVYLVNFRCCRSHDLCNEDL

SEQ ID NO: 578 - protein, 479 aa, Artificial Sequence
  PAX3__Homo_sapiens__P23760
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 579 - protein, 391 aa, Artificial Sequence
  PAX5__Homo_sapiens__Q02548
MDLEKNYPTPRTSRTGHGGVNQLGGVFVNGRPLPDVVRQRIVELAHQGVRPCDISRQLRVSHGCVSKILGRYYETGSIKPGVIGGSKPKVATPKVVEKIAEYKRQNPTMFAWEIRDRLLAERVCDNDTVPSVSSINRIIRTKVQQPPNQPVPASSHSIVSTGSVTQVSSVSTDSAGSSYSISGILGITSPSADTNKRKRDEGIQESPVPNGHSLPGRDFLRKQMRGDLFTQQQLEVLDRVFERQHYSDIFTTTEPIKPEQTTEYSAMASLAGGLDDMKANLASPTPADIGSSVPGPQSYPIVTGRDLASTTLPGYPPHVPPAGQGSYSAPTLTGMVPGSEFSGSPYSHPQYSSYNDSWRFPNPGLLGSPYYYSAAARGAAPPAAATAYDRH

SEQ ID NO: 580 - protein, 290 aa, Artificial Sequence
  PD1L1__Homo_sapiens__Q9NZQ7
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 581 - protein, 288 aa, Artificial Sequence
  PDCD1__Homo_sapiens__Q15116
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 582 - protein, 335 aa, Artificial Sequence
  PDEF__Homo_sapiens__O95238
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 583 - protein, 738 aa, Artificial Sequence
  PECA1__Homo_sapiens__P16284
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 584 - protein, 911 aa, Artificial Sequence
  PGCB__Homo_sapiens__Q96GW7
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 585 - protein, 1106 aa, Artificial Sequence
  PGFRB__Homo_sapiens__P09619
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 586 - protein, 313 aa, Artificial Sequence
  Pim-1_-Kinase__Homo_sapiens__A0A024RD25
MLLSKINSLAHLRAAPCNDLHATKLAPGKEKEPLESQYQVGPLLGSGGFGSVYSGIRVSDNLPVAIKHVEKDRISDWGELPNGTRVPMEVVLLKKVSSGFSGVIRLLDWFERPDSFVLILERPEPVQDLFDFITERGALQEELARSFFWQVLEAVRHCHNCGVLHRDIKDENILIDLNRGELKLIDFGSGALLKDTVYTDFDGTRVYSPPEWIRYHRYHGRSAAVWSLGILLYDMVCGDIPFEHDEEIIRGQVFFRQRVSSECQHLIRWCLALRPSDRPTFEEIQNHPWMQDVLLPQETAEIHLHSLSPGPSK

SEQ ID NO: 587 - protein, 100 aa, Artificial Sequence
  Pin-1__Homo_sapiens__O15428
MADEEKLPPGWEKRMSRPSGRGYYFNHITNPSQWERPSGNSSSGGKIWQGEPARVRRSHLLVKPVKAALDLAAGNHPDQGGGPGADQRLHPEDQGRREGL

SEQ ID NO: 588 - protein, 163 aa, Artificial Sequence
  Pin-1__Homo_sapiens__Q13526
MADEEKLPPGWEKRMSRSSGRVYYFNHITNASQWERPSGNSSSGGKNGQGEPARVRCSHLLVKHSQSRRPSSWRQEKITRTKEEALELINGYIQKIKSGEEDFESLASQFSDCSSAKARGDLGAFSRGQMQKPFEDASFALRTGEMSGPVFTDSGIHIILRTE

SEQ ID NO: 589 - protein, 45 aa, Artificial Sequence
  Pin-1__Homo_sapiens__Q49AR7
MQKPFEDASFALRTGEMSGPVFTDSGIHIILRTECWRQTRGPNCF

SEQ ID NO: 590 - protein, 212 aa, Artificial Sequence
  PLAC1__Homo_sapiens__Q9HBJ0
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 591 - protein, 661 aa, Artificial Sequence
  PMEL__Homo_sapiens__P40967
MDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSFVYVWKTWGQYWQVLGGPVSGLSIGTGRAMLGTHTMEVTVYHRRGSRSYVPLAHSSSAFTITDQVPFSVSVSQLRALDGGNKHFLRNQPLTFALQLHDPSGYLAEADLSYTWDFGDSSGTLISRALVVTHTYLEPGPVTAQVVLQAAIPLTSCGSSPVPGTTDGHRPTAEAPNTTAGQVPTTEVVGTTPGQAPTAEPSGTTSVQVPTTEVISTAPVQMPTAESTGMTPEKVPVSEVMGTTLAEMSTPEATGMTPAEVSIVVLSGTTAAQVTTTEWVETTARELPIPEPEGPDASSIMSTESITGSLGPLLDGTATLRLVKRQVPLDCVLYRYGSFSVTLDIVQGIESAEILQAVPSGEGDAFELTVSCQGGLPKEACMEISSPGCQPPAQRLCQPVLPSPACQLVLHQILKGGSGTYCLNVSLADTNSLAVVSTQLIMPGQEAGLGQVPLIVGILLVLMAVVLASLIYRRRLMKQDFSVPQLPHSSSHWLRLPRIFCSCPIGENSPLLSGQQV

SEQ ID NO: 592 - protein, 882 aa, Artificial Sequence
  PML__Homo_sapiens__P29590
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEAFFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 593 - protein, 1075 aa, Artificial Sequence
  POTEF__Homo_sapiens__A5A3E0
MVVEVDSMPAASSVKKPFGLRSKMGKWCCRCFPCCRESGKSNVGTSGDHDDSAMKTLRSKMGKWCRHCFPCCRGSGKSNVGASGDHDDSAMKTLRNKMGKWCCHCFPCCRGSSKSKVGAWGDYDDSAFMEPRYHVRGEDLDKLHRAAWWGKVPRKDLIVMLRDTDVNKQDKQKRTALHLASANGNSEVVKLLLDRRCQLNVLDNKKRTALIKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPEQDLKLTSEEESQRFKGSENSQPEKMSQEPEINKDGDREVEEEMKKHESNNVGLLENLTNGVTAGNGDNGLIPQRKSRTPENQQFPDNESEEYHRICELLSDYKEKQMPKYSSENSNPEQDLKLTSEEESQRLKGSENGQPEKRSQEPEINKDGDRELENFMAIEEMKKHRSTHVGFPENLTNGATAGNGDDGLIPPRKSRTPESQQFPDTENEEYHSDEQNDTQKQFCEEQNTGILHDEILIHEEKQIEVVEKMNSELSLSCKKEKDILHENSTLREEIAMLRLELDTMKHQSQLREKKYLEDIESVKKRNDNLLKALQLNELTMDDDTAVLVIDNGSGMCKAGFAGDDAPRAVFPSIVGRPRQQGMMGGMHQKESYVGKEAQSKRGILTLKYPMEHGIITNWDDMEKIWHHTFYNELRVAPEEHPVLLTEATLNPKANREKMTQIMFETFNTPAMYVAIQAVLSLYTSGRTTGIVMDSGDGVTHTVPIYEGNALPHATLRLDLAGRELPDYLMKILTEHGYRFTTMAEREIVRDIKEKLCYVALDFEQEMATVASSSSLEKSYELPDGQVITIGNERFRCPEALFQPCFLGMESCGIHETTFNSIMKSDVDIRKDLYTNTVLSGGTTMYPGMAHRMQKEIAALAPSMMKIRIIAPPKRKYSVWVGGSILASLSTFQQMWISKQEYDESGPSIVHRKCL

SEQ ID NO: 594 - protein, 584 aa, Artificial Sequence
  POTE__Homo_sapiens__Q86YR6
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSGKSNVGAWGDYDHSAFMEPRYHIRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAMLRLELDETKHQNQLRENKILEEIESVKEKTDKLLRAMQLNEEALTKTNI

SEQ ID NO: 595 - protein, 509 aa, Artificial Sequence; identical to SEQ ID NO: 190
  PRAME__Homo_sapiens__A0A024R1E6

SEQ ID NO: 596 - protein, 509 aa, Artificial Sequence; identical to SEQ ID NO: 190
  PRAME__Homo_sapiens__P78395

SEQ ID NO: 597 - protein, 214 aa, Artificial Sequence
  PRDX5/m__Homo_sapiens__P30044
MGLAGVCALRRSAGYILVGGAGGQSAAAAARRYSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 598 - protein, 102 aa, Artificial Sequence
  PRM2__Homo_sapiens__P04554
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 599 - protein, 553 aa, Artificial Sequence
  prostein__Homo_sapiens__Q96JT2
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 600 - protein, 215 aa, Artificial Sequence [sequence omitted]

SEQ ID NO: 601 - protein, 256 aa, Artificial Sequence
  proteinase-3__Homo_sapiens__P24158
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 602 - protein, 919 aa, Artificial Sequence
  PSA__Homo_sapiens__P55786
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 603 - protein, 219 aa, Artificial Sequence
  PSB9__Homo_sapiens__P28065
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 604 - protein, 114 aa, Artificial Sequence
  PSCA__Homo_sapiens__D3DWI6
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 605 - protein, 123 aa, Artificial Sequence
  PSCA__Homo_sapiens__O43653
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 606 - protein, 320 aa, Artificial Sequence
  PSGR__Homo_sapiens__Q9H255
MSSCNFTHATFVLIGIPGLEKAHFWVGFPLLSMYVVAMFGNCIVVFIVRTERSLHAPMYLFLCMLAAIDLALSTSTMPKILALFWFDSREISFEACLTQMFFIHALSAIESTILLAMAFDRYVAICHPLRHAAVLNNTVTAQIGIVAVVRGSLFFFPLPLLIKRLAFCHSNVLSHSYCVHQDVMKLAYADTLPNVVYGLTAILLVMGVDVMFISLSYFLIIRTVLQLPSKSERAKAFGTCVSHIGVVLAFYVPLIGLSVVHRFGNSLHPIVRVVMGDIYLLLPPVINPIIYGAKTKQIRTRVLAMFKISCDKDLQAVGGK

SEQ ID NO: 607 - protein, 750 aa, Artificial Sequence
  PSM__Homo_sapiens__Q04609
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 608 - protein, 1306 aa, Artificial Sequence
  PTPRC__Homo_sapiens__NP_002829
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 609 - protein, 207 aa, Artificial Sequence
  RAB8A__Homo_sapiens__P61006
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 610 - protein, 419 aa, Artificial Sequence
  RAGE-1__Homo_sapiens__Q9UQ07
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 611 - protein, 462 aa, Artificial Sequence
  RARA__Homo_sapiens__P10276
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 612 - protein, 189 aa, Artificial Sequence
  RASH__Homo_sapiens__P01112
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHQYREQIKRVKDSDDVPMVLVGNKCDLAARTVESRQAQDLARSYGIPYIETSAKTRQGVEDAFYTLVREIRQHKLRKLNPPDESGPGCMSCKCVLS

SEQ ID NO: 613 - protein, 189 aa, Artificial Sequence [sequence omitted]

SEQ ID NO: 614 - protein, 189 aa, Artificial Sequence
  RASN__Homo_sapiens__P01111
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 615 - protein, 181 aa, Artificial Sequence
  RGS5__Homo_sapiens__O15539
MCKGLAALPHSCLERAKEIKIKLGILLQKPDSVGDLVIPYNEKPEKPAKTQKTSLDEALQWRDSLDKLLQNNYGLASFKSFLKSEFSEENLEFWIACEDYKKIKSPAKMAEKAKQIYEEFIQTEAPKEVNIDHFTKDITMKNLVEPSLSSFDMAQKRIHALMEKDSLPRFVRSEFYQELIK

SEQ ID NO: 616 - protein, 724 aa, Artificial Sequence
  RHAMM/CD168__Homo_sapiens__O75330
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDRRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 617 - protein, 193 aa, Artificial Sequence
  RHOC__Homo_sapiens__P08134
MAAIRKKLVIVGDGACGKTCLLIVFSKDQFPEVYVPTVFENYIADIEVDGKQVELALWDTAGQEDYDRLRPLSYPDTDVILMCFSIDSPDSLENIPEKWTPEVKHFCPNVPIILVGNKKDLRQDEHTRRELAKMKQEPVRSEEGRDMANRISAFGYLECSAKTKEGVREVFEMATRAGLQVRKNKRRRGCPIL

SEQ ID NO: 618 - protein, 295 aa, Artificial Sequence [sequence omitted]

SEQ ID NO: 619 - protein, 866 aa, Artificial Sequence
  RU1__Homo_sapiens__Q9UHJ3
MNGEQQLDADAGSGMEEVELSWEDYLEETGSTAVPYGSFKHVDTRLQNGFAPGMKLEVAVRTDPETYWVATVITTCEQLLLLRYDGYGEDRRADFWCDIRKADLYPIGWCEQNKKTLEAPEGIRDKVSDWDEFLRQTLIGACSPPVPLLEGLRNGRNPLDLIAPGSRLECQAFQDSLSTWIVTVVENIGGRLKLRYEGLESSDNYEHWLYYLDPFLHHVGWAAQQGYELQPPSAIRHLKNEAEWQEILAKVKEEEEEPLPSYLFKDKQVIGIHTFSVNMKLEAVDPWSPFGISPATVVKVFDEKYFLVEMDDLRPENHARRSFVCHADSPGIFPVQWSLKNGLHISPPPGYPSQDFDWADYLKQCGAEAAPQRCFPPLISEHEFKENMKLEAVNPILPEEVCVATITAVRGSYLWLQLEGSKKPIPECIVSVESMDIFPLGWCETNGHPLSTPRRARVYKQRKIAVVQPEKQVPSSRTVHEGLRNQELNSTESVMINGKYCCPKIYFNHRCFSGPYLNKGRIAELPQCVGPGNCVLVLREVLTLLINAAYKPSRVLRELQLDKDSVWHGCGEVLKAKYKGKSYRATVEIVKTADRVTEFCRQTCIKLECCPNLFGPRMVLDKCSENCSVLTKTKYTHYYGKKKNKRIGRPPGGHSNLACALKKASKRRKRRKNVFVHKKKRSSASVDNTPAGSPQGSGGEDEDDPDEGDDDSLSEGSTSEQQDELQEESEMSEKKSCSSSPTQSEISTSLPPDRQRRKRELRTFSFSDDENKPPSPKEIRIEVAERLHLDSNPLKWSVADVVRFIRSTDCAPLARIFLDQEIDGQALLLLTLPTVQECMDLKLGPAIKLCHHIERIKFAFYEQFAN

SEQ ID NO: 620 - protein, 476 aa, Artificial Sequence
  RU2__Homo_sapiens__Q9UHG0
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYSELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 621 - protein, 453 aa, Artificial Sequence
  RUNX1__Homo_sapiens__Q01196
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 622 - protein, 359 aa, Artificial Sequence [sequence omitted]

SEQ ID NO: 623 - protein, 904 aa, Artificial Sequence
  SAGE__Homo_sapiens__Q9NXZ1
MQASPLQTSQPTPPEELHAAAYVFTNDGQQMRSDEVNLVATGHQSKKKHSRKSKRHSSSKRRKSMSSWLDKQEDAAVTHSICEERINNGQPVADNVLSTAPPWPDATIAHNIREERMENGQSRTDKVLSTAPPQLVHMAAAGIPSMSTRDLHSTVTHNIREERMENGQPQPDNVLSTGPTGLINMAATPIPAMSARDLYATVTHNVCEQKMENVQPAPDNVLLTLRPRRINMTDTGISPMSTRDPYATITYNVPEEKMEKGQPQPDNILSTASTGLINVAGAGTPAISTNGLYSTVPHNVCEEKMENDQPQPNNVLSTVQPVIIYLTATGIPGMNTRDQYATITHNVCEERVVNNQPLPSNALSTVLPGLAYLATADMPAMSTRDQHATIIHNLREEKKDNSQPTPDNVLSAVTPELINLAGAGIPPMSTRDQYATVNHHVHEARMENGQRKQDNVLSNVLSGLINMAGASIPAMSSRDLYATITHSVREEKMESGKPQTDKVISNDAPQLGHMAAGGIPSMSTKDLYATVTQNVHEERMENNQPQPSYDLSTVLPGLTYLTVAGIPAMSTRDQYATVTHNVHEEKIKNGQAASDNVFSTVPPAFINMAATGVSSMSTRDQYAAVTHNIREEKINNSQPAPGNILSTAPPWLRHMAAAGISSTITRDLYVTATHSVHEEKMTNGQQAPDNSLSTVPPGCINLSGAGISCRSTRDLYATVIHDIQEEEMENDQTPPDGFLSNSDSPELINMTGHCMPPNALDSFSHDFTSLSKDELLYKPDSNEFAVGTKNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 624 - protein, 800 aa, Artificial Sequence
  SART-_1__Homo_sapiens__O43290
MGSSKKHRGEKEAAGTTAAAGTGGATEQPPRHREHKKHKHRSGGSGGSGGERRKRSRERGGERGSGRRGAEAEARSSTHGRERSQAEPSERRVKREKRDDGYEAAASSKTSSGDASSLSIEETNKLRAKLGLKPLEVNAIKKEAGTKEEPVTADVINPMALRQREELREKLAAAKEKRLLNQKLGKIKTLGEDDPWLDDTAAWIERSRQLQKEKDLAEKRAKLLEEMDQEFGVSTLVEEEFGQRRQDLYSARDLQGLTVEHAIDSFREGETMILTLKDKGVLQEEEDVLVNVNLVDKERAEKNVELRKKKPDYLPYAEDESVDDLAQQKPRSILSKYDEELEGERPHSFRLEQGGTADGLRERELEEIRAKLRLQAQSLSTVGPRLASEYLTPEEMVTFKKTKRRVKKIRKKEKEVVVRADDLLPLGDQTQDGDFGSRLRGRGRRRVSEVEEEKEPVPQPLPSDDTRVENMDISDEEEGGAPPPGSPQVLEEDEAELELQKQLEKGRRLRQLQQLQQLRDSGEKVVEIVKKLESRQRGWEEDEDPERKGAIVFNATSEFCRTLGEIPTYGLAGNREEQEELMDFERDEERSANGGSESDGEENIGWSTVNLDEEKQQQDFSASSTTILDEEPIVNRGLAAALLLCQNKGLLETTVQKVARVKAPNKSLPSAVYCIEDKMAIDDKYSRREEYRGFTQDFKEKDGYKPDVKIEYVDETGRKLTPKEAFRQLSHRFHGKGSGKMKTERRMKKLDEEALLKKMSSSDTPLGTVALLQEKQKAQKTPYIVLSGSGKSMNANTITK

SEQ ID NO: 625 - protein, 958 aa, Artificial Sequence [sequence omitted]

SEQ ID NO: 626 - protein, 963 aa, Artificial Sequence
  SART-3__Homo_sapiens__Q15020
MATAAETSASEPEAESKAGPKADGEEDEVKAARTRRKVLSRAVAAATYKTMGPAWDQQEEGVSESDGDEYAMASSAESSPGEYEWEYDEEEEKNQLEIERLEEQLSINVYDYNCHVDLIRLLRLEGELTKVRMARQKMSEIFPLTEELWLEWLHDEISMAQDGLDREHVYDLFEKAVKDYICPNIWLEYGQYSVGGIGQKGGLEKVRSVFERALSSVGLHMTKGLALWEAYREFESAIVEAARLEKVHSLFRRQLAIPLYDMEATFAEYEEWSEDPIPESVIQNYNKALQQLEKYKPYEEALLQAEAPRLAEYQAYIDFEMKIGDPARIQLIFERALVENCLVPDLWIRYSQYLDRQLKVKDLVLSVHNRAIRNCPWTVALWSRYLLAMERHGVDHQVISVTFEKALNAGFIQATDYVEIWQAYLDYLRRRVDFKQDSSKELEELRAAFTRALEYLKQEVEERFNESGDPSCVIMQNWARIEARLCNNMQKARELWDSIMTRGNAKYANMWLEYYNLERAHGDTQHCRKALHRAVQCTSDYPEHVCEVLLTMERTEGSLEDWDIAVQKTETRLARVNEQRMKAAEKEAALVQQEEEKAEQRKRARAEKKALKKKKKIRGPEKRGADEDDEKEWGDDEEEQPSKRRRVENSIPAAGETQNVEVAAGPAGKCAAVDVEPPSKQKEKAASLKRDMPKVLHDSSKDSITVFVSNLPYSMQEPDTKLRPLFEACGEVVQIRPIFSNRGDFRGYCYVEFKEEKSALQALEMDRKSVEGRPMFVSPCVDKSKNPDFKVFRYSTSLEKHKLFISGLPFSCTKEELEEICKAHGTVKDLRLVTNRAGKPKGLAYVEYENESQASQAVMKMDGMTIKENIIKVAISNPPQRKVPEKPETRKAPGGPMLLPQTYGARGKGRTQLSLLPRALQRPSAAAPQAENGPAAAPAVAAPAATEAPKMSNADFAKLFLRK

SEQ ID NO: 627 - protein, 760 aa, Artificial Sequence
  SEPR__Homo_sapiens__Q12884
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 628 - protein, 333 aa, Artificial Sequence
  SIA7F__Homo_sapiens__Q969X2
MACSRPPSQCEPTSLPPGPPAGRRHLPLSRRRREMSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFITEKRVFSSWAQLYGITFSHPSWT

SEQ ID NO: 629 - protein, 356 aa, Artificial Sequence
  SIA8A__Homo_sapiens__Q92185
MSPCGRARRQTSRGAMAVLAWKFPRTRLPMGASALCVVVLCWLYIFPVYRLPNEKEIVQGVLQQGTAWRRNQTAARAFRKQMEDCCDPAHLFAMTKMNSPMGKSMWYDGEFLYSFTIDNSTYSLFPQATPFQLPLKKCAVVGNGGILKKSGCGRQIDEANFVMRCNLPPLSSEYTKDVGSKSQLVTANPSIIRQRFQNLLWSRKTFVDNMKIYNHSYIYMPAFSMKTGTEPSLRVYYTLSDVGANQTVLFANPNFLRSIGKFWKSRGIHAKRLSTGLFLVSAALGLCEEVAIYGFWPFSVNMHEQPISHHYYDNVLPFSGFHAMPEEFLQLWYLHKIGALRMQLDPCEDTSLQPTS

SEQ ID NO: 630 - protein, 418 aa, Artificial Sequence
  SIAT9__Homo_sapiens__Q9UNP4
MRTKAAGCAERRPLQPRTEAAAAPAGRAMPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKAPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFDILQYSEPQSRFWGRDKNVPTIGVIAVVLATHLCDEVSLAGFGYDLNQPRTPLHYFDSQCMAAMNFQTMHNVTTETKFLLKLVKEGVVKDLSGGIDREF

SEQ ID NO: 631 - protein, 352 aa, Artificial Sequence
  SIRT2/m__Homo_sapiens__A0A024R0G8
MDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 632 - protein, 389 aa, Artificial Sequence
  SIRT2/m__Homo_sapiens__Q8IXJ6
MAEPDPSHPLETQAGKVQEAQDSDSDSEGGAAGGEADMDFLRNLFSQTLSLGSQKERLLDELTLEGVARYMQSERCRRVICLVGAGISTSAGIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHASIDAQSGAGVPNPSTSASPKKSPPPAKDEARTTEREKPQ

SEQ ID NO: 633 - protein, 466 aa, Artificial Sequence
  SOX10__Homo_sapiens__P56693
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 634 - protein, 151 aa, Artificial Sequence
  SP17__Homo_sapiens__Q15506
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 635 - protein, 97 aa, Artificial Sequence
  SPNXA__Homo_sapiens__Q9NS26
MDKQSSAGGVKRSVPCDSNEANEMMPETPTGDSDPQPAPKKMKTSESSTILVVRYRRNFKRTSPEELLNDHARENRINPLQMEEEEFMEIMVEIPAK

SEQ ID NO: 636 - protein, 141 aa, Artificial Sequence
  SPXN3__Homo_sapiens__Q5MJ09
MEQPTSSTNGEKTKSPCESNNKKNDEMQEVPNRVLAPEQSLKKTKTSEYPIIFVYYLRKGKKINSNQLENEQSQENSINPIQKEEDEGVDLSEGSSNEDEDLGPCEGPSKEDKDLDSSEGSSQEDEDLGLSEGSSQDSGED

SEQ ID NO: 637 - protein, 188 aa, Artificial Sequence
  SSX-1__Homo_sapiens__Q16384
MNGDDTFAKRPRDDAKASEKRSKAFDDIATYFSKKEWKKMKYSEKISYVYMKRNYKAMTKLGFKVTLPPFMCNKQATDFQGNDFDNDHNRRIQVEHPQMTFGRLHRIIPKIMPKKPAEDENDSKGVSEASGPQNDGKQLHPPGKANISEKINKRSGPKRGKHAWTHRLRERKQLVIYEEISDPEEDDE

SEQ ID NO: 638 - protein, 188 aa, Artificial Sequence
  SSX-2__Homo_sapiens__Q16385
MNGDDAFARRPTVGAQIPEKIQKAFDDIAKYFSKEEWEKMKASEKIFYVYMKRKYEAMTKLGFKATLPPFMCNKRAEDFQGNDLDNDPNRGNQVERPQMTFGRLQGISPKIMPKKPAEEGNDSEEVPEASGPQNDGKELCPPGKPTTSEKIHERSGPKRGEHAWTHRLRERKQLVIYEEISDPEEDDE

SEQ ID NO: 639 - protein, 188 aa, Artificial Sequence
  SSX3__Homo_sapiens__Q99909
MNGDDTFARRPTVGAQIPEKIQKAFDDIAKYFSKEEWEKMKVSEKIVYVYMKRKYEAMTKLGFKAILPSFMRNKRVTDFQGNDFDNDPNRGNQVQRPQMTFGRLQGIFPKIMPKKPAEEGNVSKEVPEASGPQNDGKQLCPPGKPTTSEKINMISGPKRGEHAWTHRLRERKQLVIYEEISDPEEDDE

SEQ ID NO: 640 - protein, 188 aa, Artificial Sequence
  SSX-4__Homo_sapiens__O60224
MNGDDAFARRPRDDAQISEKLRKAFDDIAKYFSKKEWEKMKSSEKIVYVYMKLNYEVMTKLGFKVTLPPFMRSKRAADFHGNDFGNDRNHRNQVERPQMTFGSLQRIFPKIMPKKPAEEENGLKEVPEASGPQNDGKQLCPPGNPSTLEKINKTSGPKRGKHAWTHRLRERKQLVVYEEISDPEEDDE

SEQ ID NO: 641 - protein, 295 aa, Artificial Sequence
  ST1A1__Homo_sapiens__P50225
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPFMRKGMAGDWKTTFTVAQNERFDADYAEKMAGCSLSFRSEL

SEQ ID NO: 642 - protein, 1268 aa, Artificial Sequence
  STAG2__Homo_sapiens__Q8N3U4-2
MIAAPEIPTDFNLLQESETHFSSDTDFEDIEGKNQKQGKGKTCKKGKKGPAEKGKGGNGGGKPPSGPNRMNGHHQQNGVENMMLFEVVKMGKSAMQSVVDDWIESYKHDRDIALLDLINFFIQCSGCKGVVTAEMFRHMQNSEIIRKMTEEFDEDSGDYPLTMAGPQWKKFKSSFCEFIGVLVRQCQYSIIYDEYMMDTVISLLTGLSDSQVRAFRHTSTLAAMKLMTALVNVALNLSINMDNTQRQYEAERNKMIGKRANERLELLLQKRKELQENQDEIENMMNAIFKGVFVHRYRDAIAEIRAICIEEIGIWMKMYSDAFLNDSYLKYVGWTMHDKQGEVRLKCLTALQGLYYNKELNSKLELFTSRFKDRIVSMTLDKEYDVAVQAIKLLTLVLQSSEEVLTAEDCENVYHLVYSAHRPVAVAAGEFLYKKLFSRRDPEEDGMMKRRGRQGPNANLVKTLVFFFLESELHEHAAYLVDSMWDCATELLKDWECMNSLLLEEPLSGEEALTDRQESALIEIMLCTIRQAAECHPPVGRGTGKRVLTAKEKKTQLDDRTKITELFAVALPQLLAKYSVDAEKVTNLLQLPQYFDLEIYTTGRLEKHLDALLRQIRNIVEKHTDTDVLEACSKTYHALCNEEFTIFNRVDISRSQLIDELADKFNRLLEDFLQEGEEPDEDDAYQVLSTLKRITAFHNAHDLSKWDLFACNYKLLKTGIENGDMPEQIVIHALQCTHYVILWQLAKITESSSTKEDLLRLKKQMRVFCQICQHYLTNVNTTVKEQAFTILCDILMIFSHQIMSGGRDMLEPLVYTPDSSLQSELLSFILDHVFIEQDDDNNSADGQQEDEASKIEALHKRRNLLAAFCKLIVYTVVEMNTAADIFKQYMKYYNDYGDIIKETMSKTRQIDKIQCAKTLILSLQQLFNEMIQENGYNFDRSSSTFSGIKELARRFALTFGLDQLKTREAIAMLHKDGIEFAFKEPNPQGESHPPLNLAFLDILSEFSSKLLRQDKRTVYVYLEKFMTFQMSLRREDVWLPLMSYRNSLLAGGDDDTMSVISGISSRGSTVRSKKSKPSTGKRKVVEGMQLSLTEESSSSDSMWLSREQTLHTPVMMQTPQLTSTIMREPKRLRPEDSFMSVYPMQTEHHQTPLDYNTQVTWMLAQRQQEEARQQQERAAMSYVKLRTNLQHAIRRGTSLMEDDEEPIVEDVMMSSEGRIEDLNEGMDFDTMDIDLPPSKNRRERTELKPDFFDPASIMDESVLGVSMF

SEQ ID NO: 643 - protein, 490 aa, Artificial Sequence
  STAMP-1__Homo_sapiens__Q8NFT2
MESISMMGSPKSLSETFLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISRKLKRIKKGWEKSQFLEEGMGGTIPHVSPERVTVM

SEQ ID NO: 644 - protein, 258 aa, Artificial Sequence [sequence omitted]

SEQ ID NO: 645 - protein, 339 aa, Artificial Sequence
  STEAP-1__Homo_sapiens__Q9UHE8
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 646 - protein, 165 aa, Artificial Sequence
  Survivin-2B__Homo_sapiens__O15392-2
MGAPTLPPAWQPFLKDHRISTFKNWPFLEGCACTPERMAEAGFIHCPTENEPDLAQCFFCFKELEGWEPDDDPIGPGTVAYACNTSTLGGRGGRITREEHKKHSSGCAFLSVKKQFEELTLGEFLKLDRERAKNKIAKETNNKKKEFEETAEKVRRAIEQLAAMD

SEQ ID NO: 647 - protein, 142 aa, Artificial Sequence; identical to SEQ ID NO: 147
  survivin__Homo_sapiens__O15392

SEQ ID NO: 648 - protein, 976 aa, Artificial Sequence
  SYCP1__Homo_sapiens__A0A024R0I2
MEKQKPFALFVPPRSSSSQVSAVKPQTLGGDSTFFKSFNKCTEDDFEFPFAKTNLSKNGENIDSDPALQKVNFLPVLEQVGNSDCHYQEGLKDSDLENSEGLSRVYSKLYKEAEKIKKWKVSTEAELRQKESKLQENRKIIEAQRKAIQELQFGNEKVSLKLEEGIQENKDLIKENNATRHLCNLLKETCARSAEKTKKYEYEREETRQVYMDLNNNIEKMITAFEELRVQAENSRLEMHFKLKEDYEKIQHLEQEYKKEINDKEKQVSLLLIQITEKENKMKDLTFLLEESRDKVNQLEEKTKLQSENLKQSIEKQHHLTKELEDIKVSLQRSVSTQKALEEDLQIATKTICQLTEEKETQMEESNKARAAHSFVVTEFETTVCSLEELLRTEQQRLEKNEDQLKILTMELQKKSSELEEMTKLTNNKEVELEELKKVLGEKETLLYENKQFEKIAEELKGTEQELIGLLQAREKEVHDLEIQLTAITTSEQYYSKEVKDLKTELENEKLKNTELTSHCNKLSLENKELTQETSDMTLELKNQQEDINNNKKQEERMLKQIENLQETETQLRNELEYVREELKQKRDEVKCKLDKSEENCNNLRKQVENKNKYIEELQQENKALKKKGTAESKQLNVYEIKVNKLELELESAKQKFGEITDTYQKEIEDKKISEENLLEEVEKAKVIADEAVKLQKEIDKRCQHKIAEMVALMEKHKHQYDKIIEERDSELGLYKSKEQEQSSLRASLEIELSNLKAELLSVKKQLEIEREEKEKLKREAKENTATLKEKKDKKTQTFLLETPEIYWKLDSKAVPSQTVSRNFTSVDHGISKDKRDYLWTSAKNTLSTPLPKAYTVKTPTKPKLQQRENLNIPIEESKKKRKMAFEFDINSDSSETTDLLSMVSEEETLKTLYRNNNPPASHLCVKTPKKAPSSLTTPGSTLKFGAIRKMREDRWAVIAKMDRKKKLKEAEKLFV

SEQ ID NO: 649 - protein, 976 aa, Artificial Sequence [sequence omitted]

SEQ ID NO: 650 - protein, 976 aa, Artificial Sequence; identical to SEQ ID NO: 648
  SYCP1__Homo_sapiens__Q15431

SEQ ID NO: 651 - protein, 109 aa, Artificial Sequence [sequence omitted]

SEQ ID NO: 652 - protein, 488 aa, Artificial Sequence
  SYT-SSX-1__Homo_sapiens__A4PIV7
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEDENDSKGVSEASGPQNDGKQLHPPGKANISEKINKRSGPKRGKHAWTHRLRERKQLVIYEEISDPEEDDE

SEQ ID NO: 653 - protein, 457 aa, Artificial Sequence
  SYT-SSX-1__Homo_sapiens__A4PIV8
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEDENDSKGVSEASGPQNDGKQLHPPGKANISEKINKRSGPKRGKHAWTHRLRERKQLVIYEEISDPEEDDE

SEQ ID NO: 654 - protein, 488 aa, Artificial Sequence
  SYT-SSX-2__Homo_sapiens__A4PIV9
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEEGNDSEEVPEASGPQNDGKELCPPGKPTTSEKIHERSGPKRGEHAWTHRLRERKQLVIYEEISDPEEDDE

SEQ ID NO: 655 - protein, 457 aa, Artificial Sequence
  SYT-SSX-2__Homo_sapiens__A4PIW0
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQIMPKKPAEEGNDSEEVPEASGPQNDGKELCPPGKPTTSEKIHERSGPKRGEHAWTHRLRERKQLVIYEEISDPEEDDE

SEQ ID NO: 656 - protein, 111 aa, Artificial Sequence
  TARP__Homo_sapiens__Q0VGM3
MKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 657 - protein, 58 aa, Artificial Sequence
  TCRg__Homo_sapiens__A2JGV3
MQMFPPSPLFFFLQLLKQSSRRLEHTFVFLRNFSLMLLRYIGKKRRATRFWDPRRGTP

SEQ ID NO: 658 - protein, 376 aa, Artificial Sequence
  TF2AA__Homo_sapiens__P52655
MANSANTNTVPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 659 - protein, 567 aa, Artificial Sequence
  TGFR2__Homo_sapiens__P37173
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 660 - protein, 684 aa, Artificial Sequence [sequence omitted]

SEQ ID NO: 661 - protein, 1124 aa, Artificial Sequence
  TIE2__Homo_sapiens__Q02763
MDSLASLVLCGVSLLLSGTVEGAMDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIQRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSQQLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 662 - protein, 596 aa, Artificial Sequence
  TKTL1__Homo_sapiens__P51854
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 663 - protein, 286 aa, Artificial Sequence
  TPI/m__Homo_sapiens__P60174
MAEDGEEAEFHFAALYISGQWPRLRADTDLQRLGSSAMAPSRKFFVGGNWKMNGRKQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSDAVAQSTRIIYGGSVTGATCKELASQPDVDGFLVGGASLKPEFVDIINAKQ

SEQ ID NO: 664 - protein, 119 aa, Artificial Sequence
  TRGV11__Homo_sapiens__Q99601
MPLVVAVIFFSLWVFALGQLEQPEISISRPANKSAHISWKASIQGFSSKIIHWYWQKPNKGLEYLLHVFLTISAQDCSGGKTKKLEVSKNAHTSTSTLKIKFLEKEDEVVYHCACWIRH

SEQ ID NO: 665 - protein, 137 aa, Artificial Sequence
  TRGV9__Homo_sapiens__A4D1X2
MLSLLHTSTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVHSSRQFEPSHSINVY

SEQ ID NO: 666 - protein, 122 aa, Artificial Sequence
  TRGV9__Homo_sapiens__Q99603
MLSLLHTSTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEV

SEQ ID NO: 667 - protein, 122 aa, Artificial Sequence
  TRGV9__Homo_sapiens__Q99604
MLSLLHTSTLAVLGALCVYGAGHLEQPQISSTKTLSKTARLECVVSGIKISATSVYWYRERPGEVIQFLVSISYDGTVRKESGIPSGKFEVDRIPETSTSTLTIHNVEKQDIATYYCALWEV

SEQ ID NO: 668 - protein, 793 aa, Artificial Sequence
  TRPC1__Homo_sapiens__P48995
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQSADALLVAIDSEVVGAVDILLNHRPKRSSRPTIVKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 669 - protein, 1104 aa, Artificial Sequence
  TRP-p8__Homo_sapiens__Q7Z2W7
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDNNHTHLLLVDNGCHGHPTVEAKLRNQLEKYISERTIQDSNYGGKIPIVCFAQGGGKETLKAINTSIKNKIPCVVVEGSGQIADVIASLVEVEDALTSSAVKEKLVRFLPRTVSRLPEEETESWIKWLKEILECSHLLTVIKMEEAGDEIVSNAISYALYKAFSTSEQDKDNWNGQLKLLLEWNQLDLANDEIFTNDRRWESADLQEVMFTALIKDRPKFVRLFLENGLNLRKFLTHDVLTELFSNHFSTLVYRNLQIAKNSYNDALLTFVWKLVANFRRGFRKEDRNGRDEMDIELHDVSPITRHPLQALFIWAILQNKKELSKVIWEQTRGCTLAALGASKLLKTLAKVKNDINAAGESEELANEYETRAVELFTECYSSDEDLAEQLLVYSCEAWGGSNCLELAVEATDQHFIAQPGVQNFLSKQWYGEISRDTKNWKIILCLFIIPLVGCGFVSFRKKPVDKHKKLLWYYVAFFTSPFVVFSWNVVFYIAFLLLFAYVLLMDFHSVPHPPELVLYSLVFVLFCDEVRQWYVNGVNYFTDLWNVMDTLGLFYFIAGIVFRLHSSNKSSLYSGRVIFCLDYIIFTLRLIHIFTVSRNLGPKIIMLQRMLIDVFFFLFLFAVWMVAFGVARQGILRQNEQRWRWIFRSVIYEPYLAMFGQVPSDVDGTTYDFAHCTFTGNESKPLCVELDEHNLPRFPEWITIPLVCIYMLSTNILLVNLLVAMFGYTVGTVQENNDQVWKFQRYFLVQEYCSRLNIPFPFIVFAYFYMVVKKCFKCCCKEKNMESSVCCFKNEDNETLAWEGVMKENYLVKINTKANDTSEEMRHRFRQLDTKLNDLKGLLKEIANKIK

SEQ ID NO: 670 - protein, 698 aa, Artificial Sequence
  TSG10__Homo_sapiens__Q9BZW7
MMRSRSKSPRRPSPTARGANCDVELLKTTTRDREELKCMLEKYERHLAEIQGNVKVLKSERDKIFLLYEQAQEEITRLRREMMKSCKSPKSTTAHAILRRVETERDVAFTDLRRMTTERDSLRERLKIAQETAFNEKAHLEQRIEELECTVHNLDDERMEQMSNMTLMKETISTVEKEMKSLARKAMDTESELGRQKAENNSLRLLYENTEKDLSDTQRHLAKKKYELQLTQEKIMCLDEKIDNFTRQNIAQREEISILGGTLNDLAKEKECLQACLDKKSENIASLGESLAMKEKTISGMKNIIAEMEQASRQCTEALIVCEQDVSRMRRQLDETNDELAQIARERDILAHDNDNLQEQFAKAKQENQALSKKLNDTHNELNDIKQKVQDTNLEVNKLKNILKSEESENRQMMEQLRKANEDAENWENKARQSEADNNTLKLELITAEAEGNRLKEKVDSLNREVEQHLNAERSYKSQISTLHKSVVKMEEELQKVQFEKVSALADLSSTRELCIKLDSSKELLNRQLVAKDQEIEMRENELDSAHSEIELLRSQMANERISMQNLEALLVANRDKEYQSQIALQEKESEIQLLKEHLCLAENKMAIQSRDVAQFRNVVTQLEADLDITKRQLGTERFERERAVQELRRQNYSSNAYHMSSTMKPNTKCHSPERAHHRSPDRGLDRSLEENLCYRDF

SEQ ID NO: 671 - protein, 308 aa, Artificial Sequence
  TSPY1__Homo_sapiens__Q01534
MRPEGSLTYRVPERLRQGFCGVGRAAQALVCASAKEGTAFRMEAVQEGAAGVESEQAALGEEAVLLLDDIMAEVEVVAEEEGLVERREEAQRAQQAVPGPGPMTPESAPEELLAVQVELEPVNAQARKAFSRQREKMERRRKPHLDRRGAVIQSVPGFWANVIANHPQMSALITDEDEDMLSYMVSLEVGEEKHPVHLCKIMLFFRSNPYFQNKVITKEYLVNITEYRASHSTPIEWYPDYEVEAYRRRHHNSSLNFFNWFSDHNFAGSNKIAEILCKDLWRNPLQYYKRMKPPEEGTETSGDSQLLS

SEQ ID NO: 672 - protein, 122 aa, Artificial Sequence
  TVC_(TRGV3)__Homo_sapiens__M13231.1
MRWALLVLLAFLSPASQKSSNLEGRTKSVTRQTGSSAEITCDLTVTNTFYIHWYLHQEGKAPQRLLYYDVSTARDVLESGLSPGKYYTHTPRRWSWILRLQNLIENDSGVYYCATWDRQKLL

SEQ ID NO: 673 - protein, 267 aa, Artificial Sequence
  TX101__Homo_sapiens__Q9BY14-2
MGARQIQTSSSQTSPEEAMGTPRIQHLLILLVLGASLLTSGLELYCQKGLSMTVEADPANMFNWTTEEVETCDKGALCQETILIIKAGTETAILATKGCIPEGEEAITIVQHSSPPGLIVTSYSNYCEDSFCNDKDSLSQFWEFSETTASTVSTTLHCPTCVALGTCFSAPSLPCPNGTTRCYQGKLEITGGGIESSVEVKGCTAMIGCRLMSGILAVGPMFVREACPHQLLTQPRKTENGATCLPIPVWGLQLLLPLLLPSFIHFS

SEQ ID NO: 674 - protein, 529 aa, Artificial Sequence [sequence omitted]

SEQ ID NO: 675 - protein, 529 aa, Artificial Sequence [sequence omitted]

SEQ ID NO: 676 - protein, 529 aa, Artificial Sequence [sequence omitted]

SEQ ID NO: 677 - protein, 529 aa, Artificial Sequence [sequence omitted]

SEQ ID NO: 678 - protein, 237 aa, Artificial Sequence [sequence omitted]

SEQ ID NO: 679 - protein, 529 aa, Artificial Sequence [sequence omitted]

SEQ ID NO: 680 - protein, 529 aa, Artificial Sequence [sequence omitted]

SEQ ID NO: 681 - protein, 529 aa, Artificial Sequence [sequence omitted]

SEQ ID NO: 682 - protein, 529 aa, Artificial Sequence [sequence omitted]

SEQ ID NO: 683 - protein, 537 aa, Artificial Sequence
  TYRP1__Homo_sapiens__P17643
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 684 - protein, 519 aa, Artificial Sequence
  TYRP2__Homo_sapiens__P40126
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 685 - protein, 151 aa, Artificial Sequence
  UPA__Homo_sapiens__Q96NZ9
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 686 - protein, 174 aa, Artificial Sequence [sequence omitted]

SEQ ID NO: 687 - protein, 249 aa, Artificial Sequence
  WT1__Homo_sapiens__A0A0H5AUY0
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKG

SEQ ID NO: 688 - protein, 449 aa, Artificial Sequence; identical to SEQ ID NO: 188
  WT1__Homo_sapiens__P19544

SEQ ID NO: 689 - protein, 92 aa, Artificial Sequence
  WT1__Homo_sapiens__Q06250
MQRRGQPLENHVALIHWQSAGIPASKVHNYCNMKKSRLGRSRAVRISQPLLSPRRCPLHLTERGAGLLQPQPQGPVRTPGPPSGSHPAAADN

SEQ ID NO: 690 - protein, 81 aa, Artificial Sequence
  XAGE1__Homo_sapiens__Q9HD64
MESPKKKNQQLKVGILHLGSRQKKIRIQLRSQCATWKVICKSCISQTPGINLDLGSGVKVKIIPKEEHCKMPEAGEEQPQV

SEQ ID NO: 691 - protein, 178 aa, Artificial Sequence
  IL-10__Homo_sapiens__P22301
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 692 - protein, 134 aa, Artificial Sequence
  IL-5__Homo_sapiens__P05113
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 693 - protein, 554 aa, Artificial Sequence
  M-CSF__Homo_sapiens__P09603
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 694 - protein, 390 aa, Artificial Sequence
  TGFbeta1__Homo_sapiens__P01137
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 695 - protein, 479 aa, Artificial Sequence
  Caspase_8__Homo_sapiens__Q14790
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 696 - protein, 375 aa, Artificial Sequence
  SERPINB5__Homo_sapiens__P36952
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 697 - protein, 212 aa, Artificial Sequence [sequence omitted]

SEQ ID NO: 698 - protein, 296 aa, Artificial Sequence
  calreticulin__Homo_sapiens__B4E2Y9
MHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 699 - protein, 417 aa, Artificial Sequence
  calreticulin__Homo_sapiens__P27797
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 700 - protein, 384 aa, Artificial Sequence
  calreticulin__Homo_sapiens__Q96L12
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 701 - protein, 464 aa, Artificial Sequence
  N-myc__Homo_sapiens__P04198
MPSCSTSTMPGMICKNPDLEFDSLQPCFYPDEDDFYFGGPDSTPPGEDIWKKFELLPTPPLSPSRGFAEHSSEPPSWVTEMLLENELWGSPAEEDAFGLGGLGGLTPNPVILQDCMWSGFSAREKLERAVSEKLQHGRGPPTAGSTAQSPGAGAASPAGRGHGGAAGAGRAGAALPAELAHPAAECVDPAVVFPFPVNKREPAPVPAAPASAPAAGPAVASGAGIAAPAGAPGVAPPRPGGRQTSGGDHKALSTSGEDTLSDSDDEDDEEEDEEEEIDVVTVEKRRSSSNTKAVTTFTITVRPKNAALGPGRAQSSELILKRCLPIHQQHNYAAPSPYVESEDAPPQKKIKSEASPRPLKSVIPPKAKSLSPRNSDSEDSERRRNHNILERQRRNDLRSSFLTLRDHVPELVKNEKAAKVVILKKATEYVHSLQAEEHQLLLEKEKLQARQQQLLKKIEHARTC

SEQ ID NO: 702 - protein, 15 aa, Artificial Sequence
  Synthetic
LLQTGIHVRVSQPSL

SEQ ID NO: 703 - protein, 15 aa, Artificial Sequence
  Synthetic
ALPLKMLNIPSINVH

SEQ ID NO: 704 - protein, 15 aa, Artificial Sequence
  Synthetic
DQYVKVYLESFCEDV

SEQ ID NO: 705 - protein, 19 aa, Artificial Sequence
  Synthetic
IIKPGKISHIMLDVAFTSH

SEQ ID NO: 706 - protein, 19 aa, Artificial Sequence
  Synthetic
PQYSEHPTFTSQYRIQGKL

SEQ ID NO: 707 - protein, 16 aa, Artificial Sequence
  Synthetic
PPWQAGILARNLVPMV

SEQ ID NO: 708 - protein, 17 aa, Artificial Sequence
  Synthetic
KYQEFFWDANDIYRIFA

SEQ ID NO: 709 - protein, 5 aa, Artificial Sequence
  Synthetic
GPGPG

SEQ ID NO: 710 - protein, 5 aa, Artificial Sequence
  Synthetic
PMGLP

SEQ ID NO: 711 - protein, 15 aa, Artificial Sequence
  Synthetic
TTSAQTRSVYSQHVT

SEQ ID NO: 712 - protein, 16 aa, Artificial Sequence
  Synthetic
QLIPDDYSNTHSTRYV

SEQ ID NO: 713 - protein, 15 aa, Artificial Sequence
  Synthetic
VSVFETSGGLVVFWQ

SEQ ID NO: 714 - protein, 18 aa, Artificial Sequence
  Synthetic
NSAYEYVDYLFKRMIDLS

SEQ ID NO: 715 - protein, 30 aa, Artificial Sequence
  Synthetic
VLAELVKQIKVRVDMVRHRIKEHMLKKYTQ

SEQ ID NO: 716 - protein, 18 aa, Artificial Sequence
  Synthetic
IVPEDKREMWMACIKELH

SEQ ID NO: 717 - protein, 29 aa, Artificial Sequence
  Synthetic
KDELRRKMMYMCYRNIEFFTKNSAFPKTT

SEQ ID NO: 718 - protein, 19 aa, Artificial Sequence
  Synthetic
SVMKRRIEEICMKVFAQYI

SEQ ID NO: 719 - protein, 15 aa, Artificial Sequence
  Synthetic
AIAEESDEEEAIVAY

SEQ ID NO: 720 - protein, 20 aa, Artificial Sequence
  Synthetic
VKSEPVSEIEEVAPEEEEDG

SEQ ID NO: 721 - protein, 35 aa, Artificial Sequence
  Synthetic
TYNSSLRNSTVVRENAISFNFFQSYNQYYVFHMPR

SEQ ID NO: 722 - protein, 30 aa, Artificial Sequence
  Synthetic
DLTETLERYQQRLNTYALVSKDLASYRSFS

SEQ ID NO: 723 - protein, 20 aa, Artificial Sequence
  Synthetic
SHTTSGLHRPHFNQTCILFD

SEQ ID NO: 724 - protein, 20 aa, Artificial Sequence
  Synthetic
QLNRHSYLKDPDFLDAALDF

SEQ ID NO: 725 - protein, 15 aa, Artificial Sequence
  Synthetic
RRGRVKIDEVSRMFR

SEQ ID NO: 726 - protein, 15 aa, Artificial Sequence
  Synthetic
GIQIIYTRNHEVKSE

SEQ ID NO: 727 - protein, 20 aa, Artificial Sequence
  Synthetic
LSTPFLMEHTMPVTHPPEVA

SEQ ID NO: 728 - protein, 17 aa, Artificial Sequence
  Synthetic
PGINGKAIHLVNNESSE

SEQ ID NO: 729 - protein, 25 aa, Artificial Sequence
  Synthetic
FNNFTVSFWLRVPKVSASHLEQYGT

SEQ ID NO: 730 - protein, 28 aa, Artificial Sequence
  Synthetic
YVSIDKFRIFCKALNPKEIEKLYTSYLS

SEQ ID NO: 731 - protein, 26 aa, Artificial Sequence
  Synthetic
ILRVGYNAPGIPLYKKMEAVKLRDLK

What is claimed:

1. A pharmaceutical composition comprising a mixture of LAMP constructs, wherein the mixture of LAMP constructs collectively comprises pp65, 1E1, and gB antigens, wherein each LAMP construct of the mixture comprises two homology domains of a luminal domain of a LAMP protein, and an antigenic domain, wherein the antigenic domain is placed between the two homology domains, and wherein the antigenic domain comprises one or more of: at least one epitope of pp65, at least one epitope of gB, and at least one epitope of IE1;

wherein the LAMP protein of each LAMP construct comprises an amino acid sequence at least 90%, identical to the amino acid sequence of SEQ ID NO:1;

wherein each LAMP construct further comprises the transmembrane domain of a LAMP protein; and wherein the at least one pp65 epitope comprises one or more of: LLQTGIHVRVSQPSL (SEQ ID NO: 702), ALPLKMLNIPSINVH (SEQ ID NO: 703), DQYVKVYLESFCEDV (SEQ ID NO: 704), IIKPG-KISHIMLDVAFTSH (SEQ ID NO: 705), PQY-SEHPTFTSQYRIQGKL (SEQ ID NO: 706), PPWQAGILARNLVPMV (SEQ ID NO: 707), or KYQEFFWDANDIYRIFA (SEQ ID NO: 708); and/or wherein the at least one gB epitope comprises one or more of: TTSAQTRSVYSQHVT (SEQ ID NO: 711), QLIPDDYSNTHSTRYV (SEQ ID NO: 712), VSVFETSGGLVVFWQ (SEQ ID NO: 713), or NSAY-EYVDYLFKRMIDLS (SEQ ID NO: 714); and/or wherein the at least one 1E1 epitope comprises one or more of: VLAEL-VKQIKVRVDMVRHRIKEHMLKKYTQ (SEQ ID NO: 715), IVPEDKREMWMACIKELH (SEQ ID NO: 716), KDELRRKMMYMCYRNIEFFTKNSAFPKTT (SEQ ID NO: 717), SVMKRRIEEICMKVFAQYI (SEQ ID NO: 718), AIAEESDEEEAIVAY (SEQ ID NO: 719), or VKSEPVSEIEEVAPEEEEDG (SEQ ID NO: 720).

2. The pharmaceutical composition of claim 1, wherein each LAMP construct comprises LAMP-1 Homology Domain 1 and LAMP-1 Homology Domain 2.

3. The pharmaceutical composition of claim 2, wherein the LAMP-1 Homology Domain 1 comprises residues 29-194 of SEQ ID NO: 1 and/or the LAMP-1 Homology Domain 2 comprises residues 228-381 of SEQ ID NO: 1.

4. The pharmaceutical composition of claim 1, wherein each LAMP construct further comprises the cytosolic tail of a LAMP protein.

5. The pharmaceutical composition of claim 4, wherein the cytosolic tail comprises residues 406-417 of SEQ ID NO: 1.

6. The pharmaceutical composition of claim 1, wherein each LAMP construct each further comprises a signal sequence.

7. The pharmaceutical composition of claim 6, wherein the signal sequence is derived from a LAMP protein.

8. The pharmaceutical composition of claim 1, wherein the antigenic domain of at least one LAMP construct comprises more than one epitope and wherein the epitopes of the antigenic domain are separated by linkers.

9. The pharmaceutical composition of claim 8, wherein the linkers comprise the amino acid sequence GPGPG (SEQ ID NO: 709) or PMGLP (SEQ ID NO: 710).

10. The pharmaceutical composition of claim 1, wherein the at least one pp65 epitope comprises the amino acid sequence of SEQ ID NO: 114, or comprises an amino acid sequence at least 95% identical to SEQ ID NO: 114; and/or wherein the at least one gB epitope comprises the amino acid sequence of SEQ ID NO: 117, or comprises an amino acid sequence at least 95% identical to SEQ ID NO: 117; and/or wherein the at least one 1E1 epitope comprises the amino acid sequence of SEQ ID NO: 121, or comprises an amino acid sequence at least 95% identical to SEQ ID NO: 121.

11. The pharmaceutical composition of claim 1, wherein the antigenic domain of each LAMP construct comprises one or more of SEQ ID NO: 115, 116, 119, 120, 122, or 123.

12. The pharmaceutical composition of claim 1, wherein the antigenic domain of each LAMP construct comprises one or more of SEQ ID NO: 114, SEQ ID NO: 117, and SEQ ID NO: 121.

13. A polynucleotide encoding one or more of the LAMP constructs of claim 1.

14. A host cell comprising the polynucleotide of claim 13.

15. The pharmaceutical composition of claim 1, wherein the LAMP protein of each LAMP construct comprises the amino acid sequence of SEQ ID NO:1.

16. A method of treating a subject having glioblastoma multiforme, wherein the method comprises administering to the subject the pharmaceutical composition of claim 1.

17. The method of claim 16, wherein the method comprises a priming step and at least one boosting step.

18. The method of claim 17, wherein the pharmaceutical composition of claim 1 is administered in the priming and/or the boosting step.

19. The pharmaceutical composition of claim 2, wherein the LAMP-1 Homology Domain 1 comprises an amino acid sequence at least 95% identical to the amino acid sequence of residues 29-194 of SEQ ID NO: 1, and/or wherein the LAMP-1 Homology Domain 2 comprises the amino acid sequence of residues 228-381 of SEQ ID NO: 1.

20. The pharmaceutical composition of claim 2, wherein the LAMP-1 Homology Domain 1 comprises an amino acid sequence at least 97% identical to the amino acid sequence of residues 29-194 of SEQ ID NO: 1, and/or wherein the LAMP-1 Homology Domain 2 comprises the amino acid sequence of residues 228-381 of SEQ ID NO: 1.

21. The pharmaceutical composition of claim 1, wherein the antigenic domain of a first LAMP construct comprises at least one epitope of pp65 and at least one epitope of IE1 and the antigenic domain of a second LAMP construct comprises at least one epitope of gB.

22. The pharmaceutical composition of claim 1, wherein the antigenic domain of one LAMP construct comprises SEQ ID NO: 114 and 121 and the antigenic domain of a second LAMP construct comprises SEQ ID NO: 117.

23. The pharmaceutical composition of claim 1, wherein the transmembrane domain comprises residues 383-405 of SEQ ID NO: 1.

* * * * *